US011311582B2

(12) United States Patent
Paros et al.

(10) Patent No.: US 11,311,582 B2
(45) Date of Patent: Apr. 26, 2022

(54) BACTERIOPHAGE COMPOSITIONS AND METHODS OF USE THEREOF

(71) Applicant: Locus Biosciences, Inc., Research Triangle Park, CA (US)

(72) Inventors: Mike Paros, Centralia, WA (US); Ryan Honaker, Oakland, CA (US); Zachary Alan Hobbs, Oakland, CA (US); Manuela Richter, Palo Alto, CA (US); Lucia Mokres, Redwood City, CA (US); Ermir Kadija, Shkodër, AL (US)

(73) Assignee: LOCUS BIOSCIENCES, INC., Research Triangle Park, NC (US)

( * ) Notice: Subject to any disclaimer, the term of this patent is extended or adjusted under 35 U.S.C. 154(b) by 126 days.

(21) Appl. No.: 15/777,615

(22) PCT Filed: Nov. 18, 2016

(86) PCT No.: PCT/US2016/062952
§ 371 (c)(1),
(2) Date: May 18, 2018

(87) PCT Pub. No.: WO2017/087909
PCT Pub. Date: May 26, 2017

(65) Prior Publication Data
US 2018/0333444 A1 Nov. 22, 2018

Related U.S. Application Data

(60) Provisional application No. 62/257,699, filed on Nov. 19, 2015.

(51) Int. Cl.
| | | |
|---|---|---|
| *C12N 7/00* | (2006.01) | |
| *A61K 35/76* | (2015.01) | |
| *A61P 31/04* | (2006.01) | |

(52) U.S. Cl.
CPC .............. *A61K 35/76* (2013.01); *A61P 31/04* (2018.01); *C12N 7/00* (2013.01); *C12N 2795/00032* (2013.01); *C12N 2795/10121* (2013.01); *C12N 2795/10132* (2013.01)

(58) Field of Classification Search
None
See application file for complete search history.

(56) References Cited

U.S. PATENT DOCUMENTS

| | | |
|---|---|---|
| 7,958,513 B2 | 6/2011 | Jia et al. |
| 2015/0132263 A1 | 5/2015 | Liu et al. |
| 2015/0322409 A1 | 11/2015 | Yoon et al. |
| 2015/0353901 A1 | 12/2015 | Liu et al. |
| 2018/0155729 A1 | 6/2018 | Beisel et al. |

FOREIGN PATENT DOCUMENTS

| | | |
|---|---|---|
| JP | S5939830 A | 3/1984 |
| WO | WO-2007148919 A1 | 12/2007 |
| WO | WO-2009035303 A2 | 3/2009 |
| WO | WO-2010013204 A1 | 2/2010 |
| WO | WO-2015070193 A1 | 5/2015 |
| WO | WO-2016084088 A1 | 6/2016 |
| WO | WO-2016172380 A1 | 10/2016 |
| WO | WO-2017087909 A1 | 5/2017 |

OTHER PUBLICATIONS

Almeida et al. Intracellular fate of strains of *Escherichia coli* isolated from dairy cows with acute or chronic mastitis. Vet. Res. Commun. 35:89-101 (2011).
Almeida et al. *Staphylococcus aureus* invasion of bovine mammary epithelial cells. J. Dairy Sci. 79:1021-1026 (1996).
Bicalho et al. Susceptibility of *Escherichia coli* isolated from uteri of postpartum dairy cows to antibiotic and environmental bacteriophages. Part I: Isolation and lytic activity estimation of bacteriophages. J. Dairy Sci. 93:93-104 (2010).
Bradley. Bovine Mastitis: An Evolving Disease. Vet. J. 164:116-128 (2002).
Bradley et al. A comparison of broad-spectrum and narrow-spectrum dry cow therapy used alone and in combination with a teat sealant. J. Dairy Sci. 94:692-704 (2011).
Bradley et al. Adaptation of *Escherichia coli* to the Bovine Mammary Gland. J. Clin. Microbiol. 39:1845-1849 (2001).
Brussow. Phage therapy: the *Escherichia coli* experience. Microbiology. 151:2133-2140 (2005).
Callaway et al. Bacteriophage isolated from feedlot cattle can reduce *Escherichia coli* 01 57:H7 populations in ruminant gastrointestinal tracts. Foodborne Pathog. Dis. 5:183-191 (2008).
Camacho et al. BLAST+: architecture and applications. BMC bioinformatics 10.1:1 (2009).
Capparelli et al. Experimental Phage Therapy against *Staphylococcus aureus* in Mice. Antimicrob. Agents Chemother. 51:2765-2773 (2007).
Carlson. Working with bacteriophages: common techniques and methodological approaches. CRC Press. 437-494 (2005).
Davis et al. Microbiology, 3rd Ed., Harper & Row, Hagerstown, Md. pp. 874-877, 880-883 (1980).
De La Fuente et al. Small molecules with antimicrobial activity against *E. coli* and *P. aeruginosa* identified by high-throughput screening. Br. J. Pharmacol. 149:551-559 (2006).
Dogan et al. Adherent and invasive *Escherichia coli* are associated with persistent bovine mastitis, Vet. Microbiol. 116:270-282 (2006).
Dogan et al. Phylogroup and 1pfA influence epithelial invasion by mastitis associated *Escherichia coli*. Vet. Microbiol. 159:163-170 (2012).

(Continued)

*Primary Examiner* — Nicole Kinsey White
(74) *Attorney, Agent, or Firm* — Wilson Sonsini Goodrich & Rosati

(57) ABSTRACT

The present application provides bacteriophage compositions, and methods of treating or preventing bacterial infections using the bacteriophage compositions. The bacteriophage compositions can inhibit bacterial adhesion, invasion, and/or colonization in epithelial cells. The compositions and methods described herein are useful for treating or preventing mastitis in dairy cows.

17 Claims, 13 Drawing Sheets

Specification includes a Sequence Listing.

(56) References Cited

OTHER PUBLICATIONS

Dopfer et al. Adhesion and invasion of *Escherichia coli* from single and recurrent clinical cases of bovine mastitis in vitro. Vet. Microbiol. 74:331-343 (2000).
Dopfer et al. Recurrent Clinical Mastitis Caused by *Escherichia coli* in Dairy Cows. J. Dairy Sci. 82:80-85 (1999).
Garcia et al. Prevalence of bacteriophages infecting *Staphylococcus aureus* in dairy samples and their potential as biocontrol agents. J. Dairy Sci. 92:3019-3026 (2009).
Gill et al. Bovine whey proteins inhibit the interaction of *Staphylococcus aureus* and bacteriophage K. J. Appl. Microbiol. 101:377-386 (2006a).
Gill et al. Efficacy and Pharmacokinetics of Bacteriophage Therapy in Treatment of Subclinical *Staphylococcus aureus* Mastitis in Lactating Dairy Cattle. Antimicrob. Agents Chemother. 50:2912-2918 (2006b).
Godden et al. Effectiveness of an internal teat seal in the prevention of new intramammary infections during the dry and early-lactation periods in dairy cows when used with a dry cow intramammary antibiotic. J. Dairy Sci. 86:3899-3911 (2003).
Halasa et al. Economic effects of bovine mastitis and mastitis management: A review. Vet. Q. 29:18-31 (2007).
Heikkila et al. Costs of clinical mastitis with special reference to premature culling J Dairy Sci. 95:139-150 (2012).
Hogan et al. Coliform mastitis. Vet. Res. 34:507-519 (2003).
Hsia et al. Phage infection of the obligate intracellular bacterium, Chlamydia psittaci strain Guinea Pig Inclusion Conjunctivitis. Microbes Infect. 2:761-772 (2000).
Huynh et al. Establishment of bovine mammary epithelial cells (MAC-T): an in vitro model for bovine lactation. Exp. Cell Res. 197:191-199 (1991).
Kropinski et al. Enumeration of bacteriophages by double agar overlay plaque assay. Methods Mol. Biol. Clifton NJ. 501:69-76 (2009).
Kropinski et al. The host-range, genomics and proteomics of *Escherichia coli* 0157:H7 bacteriophage rV5. Virol. J. 10:76 (2013).
Lingohr et al. Chapter 3: Determination of Bacteriophage Genome Size by Pulsed-Field Gel Electrophoresis. In Bacteriophages—Methods and Protocols, vol. 2: Molecular and Applied Aspects, 2. Humana Press, (pp. 19-25) (2009).
Lippolis et al. Proteomic analysis reveals protein expression differences in *Escherichia coli* strains associated with persistent versus transient mastitis. J. Proteomics. 108:373-381 (2014).
Lu et al. The next generation of bacteriophage therapy. Curr. Opin. Microbiol. 14:524-531 (2011).
Madera et al. Milk contamination and resistance to processing conditions determine the fate of Lactococcus lactis bacteriophages in dairies. Appl. Environ. Microbiol. 70:7365-7371 (2004).
McLean et al. Phage inhibition of *Escherichia coli* in ultrahigh-temperature-treated and raw milk. Foodborne Pathog. Dis. 10:956 962 (2013).
Mollenkopf et al. Association of dry cow therapy with the antimicrobial susceptibility of fecal coliform bacteria in dairy cows. Prey. Vet. Med. 96:30-35 (2010).
Moser et al. Resistance profiles and genetic diversity of *Escherichia coli* strains isolated from acute bovine mastitis. Schweiz. Arch. Fiir Tierheilkd. 155:351-357 (2013).
Mullen et al. Comparisons of milk quality on North Carolina organic and conventional dairies. J. Dairy Sci. 96:6753-6762 (2013).
Mullen et al. Effect of 2 herbal intramammary products on milk quantity and quality compared with conventional and no dry cow therapy. J. Dairy Sci. 97:3509-3522 (2014).
O'Flaherty et al. Inhibition of bacteriophage K proliferation on *Staphylococcus aureus* in raw bovine milk. Lett. Appl. Microbiol. 41:274-279 (2005).
Passey et al. *Escherichia coli* isolated from bovine mastitis invade mammary cells by a modified endocytic pathway. Vet. Microbiol. 130:151-164 (2008).
PCT/US2016/062952 International Search Report and Written Opinion dated Feb. 9, 2017.

Peng et al. IDBA—A Practical Iterative de Bruijn Graph De Novo Assembler. RECOMB. Lisbon) PriceTI version 1.2 (18 pgs) (2010).
Porter et al. In vitro evaluation of a novel bacteriophage cocktail as a preventative for bovine coliform mastitis. J Dairy Sci 99:2053-2062 (2016).
Ray et al. Life on the inside: the intracellular lifestyle of cytosolic bacteria. Nat. Rev. Microbiol. 7:333-340 (2009).
Raya et al. Isolation and Characterization of a New T-Even Bacteriophage, CEV1, and Determination of Its Potential To Reduce *Escherichia coli* 0157:H7 Levels in Sheep. Appl. Environ. Microbic. 72:6405-6410 (2006).
Raya et al. Naturally resident and exogenously applied T4-like and T5-like bacteriophages can reduce *Escherichia coli* 0157:H7 levels in sheep guts. Bacteriophage. 1:15 24 (2011).
Ruby et al. Price: Software for the Targeted Assembly of Components of (Meta) Genomic Sequence Data. G3 (Bethesda) 3(5):865-880 (2013).
Rutherford et al. Artemis: sequence visualization and annotation. Bioinformatics (Oxford, England) 10:944-5 (2000).
Saini et al. Herd-level relationship between antimicrobial use and presence or absence of antimicrobial resistance in gram-negative bovine mastitis pathogens on Canadian dairy farms. J. Dairy Sci. 96:4965-4976 (2013).
Santos et al. Susceptibility of *Escherichia coli* isolated from uteri of postpartum dairy cows to antibiotic and environmental bacteriophages. Part II: In vitro antimicrobial activity evaluation of a bacteriophage cocktail and several antibiotics. J. Dairy Sci. 93:105-114 (2010).
Schalm et al. Experiments and observations leading to development of the California mastitis test. J Am Vet Med Assoc 130:199-204 (1957).
Schwarzer et al. A Multivalent Adsorption Apparatus Explains the Broad Host Range of Phage phi92: a Comprehensive Genomic and Structural Analysis. J. Virol. 86:10384-10398 (2012).
Smith et al. Effectiveness of Phages in Treating Experimental *Escherichia coli* Diarrhea in Calves, Piglets and Lambs. J. Gen. Microbiol. 129:2659-2675 (1983).
Suojala et al. Treatment for bovine *Escherichia coli* mastitis—an evidence-based approach. J. Vet. Pharmacol. Ther. 36:521-531 (2013).
Synnott et al. Isolation from Sewage Influent and Characterization of Novel *taphylococcus aureus* Bacteriophages with Wide Host Ranges and Potent Lytic Capabilities. Applied and Environmental Microbiology 75(13):4483-4490 (2009).
Tsonos et al. Hurdles in bacteriophage therapy: Deconstructing the parameters. Vet. Microbiol. 171:460-469 (2014).
Wenz et al. *Escherichia coli* isolates' serotypes, genotypes, and virulence genes and clinical coliform mastitis severity. J. Dairy Sci. 89:3408-3412 (2006).
Zadoks et al. Changing trends in mastitis. Ir Vet J. 62 Suppl 4. S59-70 (2009).
Baskanchiladze et al. Chemotherapeutic effectiveness ofantibiotics in combination with papain in experimental septicemia. Database accession No. NLM6696400. Antibiotiki 29(1):33-35 (1984) (Abstract Only).
Cochrane et al. Complete genome sequences and analysis of the *Fusobacterium nucleaturn* subspecies animalis 7-1 bacteriopnage ΦFunu1 and ΦFunu2. Anaerobe 38:125-129 (2016).
De Oliveira et al. Influence of papain in biofilm formed by methicillin-resistant *Staphylococcus* epidermidis and methicillin-resistant *Staphylococcus haemolyticus* isolates. Braz J Pharm Sci 50(2):261-267 (2014).
Labrie et al. Bacteriophage resistance mechanisms. Nat Rev Microbiol 8:317-327 (2010).
Nale et al. Diverse temperate bacteriopnage carriage in Clostridium difficile 027 strains. PloS One 7(5):1-9 (2012).
Sanders. Therapy of chlamydia infectiosn with tetracyclines. Database accession No. EMB-1991043367. Int'l J Experimental & Clinical Chemotherapy 3(2):101-106 (1990).
Seed et al. A bacteriophage encodes its own CRISPRCas adaptive response to evade host innate immunity. Nature 494(7438):489-491 (2013).

(56) References Cited

OTHER PUBLICATIONS

Uchiyama et al. Characterization of lielicobacter pylon bactertophage KHP30. Applied and environmental microbiology 79(10):3176-3184 (2013).

Young et al. Phage-induced expression of CRISPR-associated proteins is revealed by shotgun proteomics in *Streptococcus thermophilus*. PLoS ONE 7(5):e38077 (2012).

| Time point | Treated | Control | P-value |
|---|---|---|---|
| 12 hours | 1292 | 316266 | <.0001 |
| 24 | 1058 | 4368 | 0.2111 |
| 36 | 525 | 2428 | 0.1768 |
| 48 | 501 | 3222 | 0.1016 |
| 72 | 165 | 340 | 0.5231 |
| 96 | 130 | 438 | 0.2825 |
| 120 | 100 | 178 | 0.6103 |
| 144 | 100 | 158 | 0.6851 |

| Time point | Treated | Control | P-value |
|---|---|---|---|
| 12 hours | 778 | 218 | 0.0165 |
| 24 | 1027 | 1209 | 0.7548 |
| 36 | 683 | 1322 | 0.2074 |
| 48 | 1169 | 1307 | 0.8296 |
| 72 | 1323 | 1882 | 0.5004 |
| 96 | 1343 | 1404 | 0.9326 |
| 120 | 810 | 918 | 0.8116 |
| 144 | 620 | 1434 | 0.1106 |

| Time point | Treated | | Control | | P-value |
|---|---|---|---|---|---|
| | Least squares mean | SEM | Least squares mean | SEM | |
| 12 hours | 27.8750 | 2.5388 | 31.2500 | 2.5388 | 0.3486 |
| 24 | 19.0000 | 2.5388 | 13.8750 | 2.5388 | 0.1553 |
| 36 | 18.2500 | 2.5388 | 19.1250 | 2.5388 | 0.8078 |
| 48 | 21.0625 | 2.5388 | 17.5000 | 2.5388 | 0.3225 |
| 60 | 29.5000 | 2.5388 | 26.8750 | 2.5388 | 0.4657 |
| 72 | 27.3750 | 2.5388 | 26.1250 | 2.5388 | 0.7282 |
| 84 | 29.0000 | 2.5388 | 29.1250 | 2.5388 | 0.9723 |
| 96 | 26.6250 | 2.5388 | 27.1250 | 2.5388 | 0.8894 |
| 108 | 30.0000 | 2.5388 | 29.5000 | 2.5388 | 0.8894 |
| 120 | 34.3750* | 2.5388 | 25.5000 | 2.5388 | 0.0144 |
| 132 | 26.0000 | 2.5388 | 30.8750 | 2.5388 | 0.1763 |
| 144 | 31.1250 | 2.5388 | 28.6250 | 2.5388 | 0.4872 |
| 156 | 22.6250* | 2.5388 | 31.5000 | 2.5388 | 0.0144 |

| Time point | Treated | | Control | | P-value |
|---|---|---|---|---|---|
| | Least squares mean | SEM | Least squares mean | SEM | |
| 6 hours | 16.0388 | 2.1565 | 11.2875 | 2.1565 | 0.1215 |
| 12 | 9.6275 | 2.1565 | 8.4875 | 2.1565 | 0.7091 |
| 24 | 11.8263 | 2.1565 | 7.6313 | 2.1565 | 0.1712 |
| 36 | 13.6288 | 2.1565 | 9.3362 | 2.1565 | 0.1615 |
| 48 | 13.9638 | 2.1565 | 10.1737 | 2.1565 | 0.2161 |
| 72 | 13.6175 | 2.1565 | 10.6738 | 2.1565 | 0.3361 |
| 96 | 13.0775 | 2.1565 | 10.0125 | 2.1565 | 0.3166 |
| 120 | 12.5975 | 2.1565 | 10.8912 | 2.1565 | 0.5767 |
| 144 | 12.8388 | 2.1565 | 10.7863 | 2.1565 | 0.5021 |

| Time point | Treated | | Control | | P-value |
|---|---|---|---|---|---|
| | Least squares mean | SEM | Least squares mean | SEM | |
| 6 hours | 3.6438 | 0.6590 | 3.3837 | 0.6590 | 0.7807 |
| 12 | 1.8538 | 0.6590 | 2.0863 | 0.6590 | 0.8034 |
| 24 | 3.0975 | 0.6590 | 1.3738 | 0.6590 | 0.0665 |
| 36 | 4.4375* | 0.6590 | 2.4487 | 0.6590 | 0.0346 |
| 48 | 4.9088* | 0.6590 | 2.2000 | 0.6590 | 0.0043 |
| 72 | 4.4975 | 0.6590 | 3.2963 | 0.6590 | 0.1996 |
| 96 | 4.0175 | 0.6590 | 3.1125 | 0.6590 | 0.3332 |
| 120 | 3.8713 | 0.6590 | 3.9863 | 0.6590 | 0.9020 |
| 144 | 4.3525 | 0.6590 | 4.0712 | 0.6590 | 0.7633 |

Average Histopathology Score per Cow

| Cow ID | Necrosis P-Value | PMN P-Value | Lymphocytes P-Value | Treated Quarter | Control Quarter | Quarter P-Value |
|---|---|---|---|---|---|---|
| 17 | 0.411 | 0.072 | 0.083 | 1.25* | 0.97* | 0.042 |
| 19 | N/A | 0.486 | 0.118 | 0.53 | 0.31 | 0.133 |
| 20 | N/A | 0.195 | 0.810 | 0.63 | 0.63 | 1.000 |

FIG. 13A

Histopathology Statistical Analysis

| Group | Least squares mean | SEM | P-value |
|---|---|---|---|
| Treated | 24.14 | 6.24 | 0.5984 |
| Untreated | 19.10 | 6.24 | |

FIG. 13B

BACTERIOPHAGE COMPOSITIONS AND METHODS OF USE THEREOF

CROSS REFERENCE TO RELATED APPLICATIONS

This application is a National Phase filing under 35 U.S.C. § 371 of International Application No. PCT/US2016/062952 having an International Filing Date of Nov. 18, 2016, which claims priority benefit of U.S. Provisional Patent Application No. 62/257,699 filed on Nov. 19, 2015, the contents of which are incorporated herein by reference in their entirety.

FIELD OF THE INVENTION

The present application relates to bacteriophage compositions, and methods of treating or preventing bacterial infections using the bacteriophage compositions.

SUBMISSION OF SEQUENCE LISTING ON ASCII TEXT FILE

The content of the following submission on ASCII text file is incorporated herein by reference in its entirety: a computer readable form (CRF) of the Sequence Listing (file name: 750432000400SEQLISTING.txt, date recorded: May 18, 2018, size: 916 KB).

BACKGROUND OF THE INVENTION

Bacteriophages are viruses that can replicate inside bacteria, thereby suppressing bacterial proliferation. The use of bacterial viruses as therapeutic agents was explored as early as 1919 by the co-discoverer of phages, Felix d'Herelle. There has been a recent resurgence of interest in phage therapy due to the emergence of antibiotic resistant bacteria (Saini et al. J. Dairy Sci. (2013) 96:4965-4976; Tsonos et al. Vet. Microbiol. (2014) 171:460-469). Furthermore, the concern over routine prophylactic use of antibiotics due to bacterial resistance in food animals has revived research into the use of bacteriophage to combat infections in dairy cattle.

A number of animal studies have demonstrated the safe and efficacious use of phage against E. coli infections (Brussow, H. Microbiology. (2005) 151:2133-2140; Lu, T. K., and M. S. Koeris. Curr. Opin. Microbiol. (2011) 14:524-531). In the 1980s, Smith and Huggins used coliphages to protect calves, piglets, and lambs from diarrhea after they were given oral doses of enteropathogenic E. coli strains (Smith, H. W., and M. B. Huggins. J. Gen. Microbiol. (1983) 129:2659-2675). A cocktail of different phages against E. coli 0157:H7 has been demonstrated to reduce shedding of these bacteria in experimentally infected sheep (Raya et al. Bacteriophage. (2011) 1:15-24; Raya et al. Appl. Environ. Microbiol. (2006) 72:6405-6410; Callaway et al. Foodborne Pathog. Dis. (2008) 5:183-191). Additionally, bacteriophages have been isolated against E. coli associated with post-partum uterine infections with the hope of using phages as an alternative to antibiotics for the treatment of metritis in dairy cows (Bicalho et al. J. Dairy Sci. (2010) 93:93-104; Santos et al. J. Dairy Sci. (2010) 93:105-114).

Bovine mastitis is one of the most common diseases in dairy cows worldwide. Mastitis reduces milk yield and increases milk production costs due to discarded milk, preventative and therapeutic expenses, and premature culling (Halasa et al. Vet. Q. (2007) 29:18-31; Heikkilä et al. J. Dairy Sci. (2012) 95:139-150). Additionally, mastitis has a significant negative impact on milk quality and animal welfare (Bradley, A. J. Vet. J. (2002) 164:116-128). E. coli is a pathogen frequently associated with bovine mastitis in well-managed dairies, and often causes severe mammary gland inflammation in the cow (Bradley et al. J. Dairy Sci. (2011) 94:692-704; Hogan and Smith. Vet. Res. (2003) 34:507-519). E. coli can also play a role in chronic subclinical intramammary infections, and its persistence can be associated with different bacterial strain characteristics allowing intracellular invasion of mammary epithelial cells (Döpfer et al., J. Dairy Sci. (1999) 82:80-85; Dogan et al., Vet. Microbiol. (2012) 159:163-170; Lippolis et al., J. Proteomics. (2014) 108:373-381).

Broad-spectrum antibiotics have been used systemically or as intramammary treatment for coliform mastitis. Therapeutic trials have shown questionable clinical efficacy of antibiotics against E. coli infections during lactation and their use is often discouraged in such cases (Suojala et al. J. Vet. Pharmacol. Ther. (2013) 36:521-531). Intramammary antibiotics administered during the dry period can help eliminate coliform infections present at the end of lactation as well as preventing new intramammary infections prior to calving (Bradley and Green. J. Clin. Microbiol. (2001) 39:1845-1849). Blanket dry cow therapy with long acting antibiotics is considered a standard practice on a majority of dairies worldwide. However, the routine prophylactic use of intramammary antibiotics on dairies is now under public scrutiny due to concerns over the transfer of antibiotic resistance genes to human pathogens (Mollenkopf et al., Prev. Vet. Med. (2010) 96:30-35). The National Action Plan for Combating Antibiotic-Resistant Bacteria calls for the development of antibiotic alternatives and a reduction of use of shared class antibiotics (used in both humans and animals) in agriculture. Additionally, organic dairies are not permitted to use dry cow antibiotics and there is a lack of efficacious alternative preventatives for coliform mastitis (Mullan et al., J. Dairy Sci. (2013) 96:6753-6762; Mullan et al., J. Dairy Sci. (2014) 97:3509-3522). Therefore, there remains a need for finding a solution to the costly problem of bacterial infection and colonization in dairy herds leading to clinical and sub-clinical mastitis.

E. coli bacteriophages often infect specific bacteria strains, which limits their ability to infect a diverse group of disease-causing coliform isolates. It has been suggested that agglomeration of bacteria can preclude phage infection as well. Additionally, work done with Staphylococcus aureus and bacteriophage K showed that phage attachment and lytic activity was suppressed in raw whole milk, but not in heat-treated milk or milk whey (O'Flaherty, et al., Lett. Appl. Microbiol. (2005) 41:274-279; Gill et al., J. Appl. Microbiol. (2006) 101: 377-386). To overcome such obstacles, Brüssow (2005) had suggested the use of several phages in a cocktail as a potential way to increase the host range specificity of a bacteriophage.

The disclosures of all publications, patents, patent applications and published patent applications referred to herein are hereby incorporated herein by reference in their entirety.

BRIEF SUMMARY OF THE INVENTION

The present invention provides bacteriophage compositions and methods for treating or preventing bacterial infections using the bacteriophage compositions. The bacteriophage compositions and methods are useful for a variety of applications, including human and veterinary medicine.

One aspect of the present application provides a composition comprising a bacteriophage and a delivery vehicle, wherein the bacteriophage targets Escherichia coli, and wherein the bacteriophage comprises a genome sequence having at least about 95% (such as 100%) sequence identity to the genome sequence of a bacteriophage selected from the group consisting of p0031, p0032, p0033, p0034, and p0045. In some embodiments, the bacteriophage comprises a genome sequence having at least about 95% (such as 100%) sequence identity to SEQ ID NOs: 1-5.

In some embodiments, there is provided a composition comprising a bacteriophage and a delivery vehicle, wherein the bacteriophage targets *Escherichia coli*, and wherein the bacteriophage comprises a genome having at least about 95% (such as 100%) sequence identity to the genome sequence of p0031 (IDAC Accession Number: 161116-01). In some embodiments, the bacteriophage is p0031. In some embodiments, the composition further comprises a Schizo-T4-like bacteriophage. In some embodiments, the composition further comprises one or more (such as 1, 2, or more) rV5-related and phi92-related bacteriophages.

In some embodiments, there is provided a composition comprising a bacteriophage and a delivery vehicle, wherein the bacteriophage targets *Escherichia coli*, and wherein the bacteriophage comprises a genome having at least about 95% (such as 100%) sequence identity to the genome sequence of p0032 (IDAC Accession Number: 161116-02). In some embodiments, the bacteriophage is p0032. In some embodiments, the composition further comprises a T4-like bacteriophage. In some embodiments, the composition further comprises one or more (such as 1, 2, or more) rV5-related and phi92-related bacteriophages.

In some embodiments, there is provided a composition comprising a bacteriophage and a delivery vehicle, wherein the bacteriophage targets *Escherichia coli*, and wherein the bacteriophage comprises a genome having at least about 95% (such as 100%) sequence identity to the genome sequence of p0033 (IDAC Accession Number: 161116-03). In some embodiments, the bacteriophage is p0033. In some embodiments, the composition further comprises a T4-like bacteriophage. In some embodiments, the composition further comprises a Schizo-T4-like bacteriophage. In some embodiments, the composition further comprises an rV5-related and phi92-related bacteriophage.

In some embodiments, there is provided a composition comprising a bacteriophage and a delivery vehicle, wherein the bacteriophage targets *Escherichia coli*, and wherein the bacteriophage comprises a genome having at least about 95% (such as 100%) sequence identity to the genome sequence of p0034 (IDAC Accession Number: 101116-01). In some embodiments, the bacteriophage is p0034. In some embodiments, the composition further comprises a T4-like bacteriophage. In some embodiments, the composition further comprises a Schizo-T4-like bacteriophage. In some embodiments, the composition further comprises an rV5-related and phi92-related bacteriophage.

In some embodiments, there is provided a composition comprising a bacteriophage and a delivery vehicle, wherein the bacteriophage targets *Escherichia coli*, and wherein the bacteriophage comprises a genome having at least about 95% (such as 100%) sequence identity to the genome sequence of p0045 (IDAC Accession Number: 161116-04). In some embodiments, the bacteriophage is p0045. In some embodiments, the composition further comprises a T4-like bacteriophage. In some embodiments, the composition further comprises a Schizo-T4-like bacteriophage. In some embodiments, the composition further comprises one or more (such as 1, 2, or more) rV5-related and phi92-related bacteriophages.

In some embodiments according to any one of the compositions described above, the composition comprises at least two bacteriophages. In some embodiments, the composition comprises at least three bacteriophages. In some embodiments, the composition comprises at least four bacteriophages. In some embodiments, the at least four bacteriophages comprise p0031, p0032, p0033, and p0034. In some embodiments, the composition comprises at least five bacteriophages. In some embodiments, the at least five bacteriophages comprise p0031, p0032, p0033, p0034 and p0045.

In some embodiments according to any one of the compositions described above, the composition further comprises an additional bacteriophage targeting a Gram-negative bacterium. In some embodiments, the Gram-negative bacterium is selected from the group consisting of *Escherichia coli*, *Enterobacter* spp., *Citrobacter* spp., and *Klebsiella* spp., *Hafnia* spp., *Corynebacterium pyogenes*, *Mycoplasma bovis*, *Serratia* spp., *Pasteurella* spp., *Proteus* spp., *Campylobacter* ssp., *Salmonella* ssp., *Pseudomonas aeruginosa*, and *Brucella melitensis*. In some embodiments, the additional bacteriophage targeting the Gram-negative bacterium is lytic.

In some embodiments according to any one of the compositions described above, the composition further comprises an additional bacteriophage targeting a Gram-positive bacterium. In some embodiments, the Gram-positive bacterium is selected from the group consisting of *Staphylococcus aureus*, *Streptococcus agalactiae*, *Streptococcus uberis*, *Streptococcus dysgalactiae*, *Streptococcus equinus*, *Staphylococcus hyicus*, *Staphylococcus simulans*, *Staphylococcus epidermidis*, *Staphylococcus chromogenes*, *Staphylococcus xylosus*, coagulase negative Stapholococci (CNS), *Corynebacterium bovis*, *Pasteurella* spp., *Trueperella pyogenes*, *Clostridium perfingens*, *Clostridium difficile*, and *Listeria* ssp. In some embodiments, the additional bacteriophage targeting the Gram-positive bacterium is lytic.

In some embodiments according to any one of the compositions described above, the delivery vehicle is suitable for injection. In some embodiments, the delivery vehicle is suitable for oral administration. In some embodiments, the delivery vehicle is suitable for topical application. In some embodiments, the delivery vehicle is bismuth-free. In some embodiments, the delivery vehicle contains bismuth. In some embodiments, the delivery vehicle is an ointment. In some embodiments, the delivery vehicle is a teat sealant. In some embodiments, the delivery vehicle is not water.

One aspect of the present application provides a method of treating or preventing a disease caused by a bacterial infection in an individual comprising administering to the individual an effective amount of any one of the compositions described above. In some embodiments, the disease is selected from the group consisting of mastitis, metritis, otitis, dermatitis, cystitis, endophthalmitis, conjunctivitis, sinusitis, and infections of oral cavity.

One aspect of the present application provides a method of treating or preventing mastitis caused by a bacterial infection in an individual comprising administering to the individual an effective amount of any one of the compositions described above. In some embodiments, the individual is a dairy cow. In some embodiments, the mastitis is caused by a coliform bacterium. In some embodiments, the mastitis is subclinical mastitis. In some embodiments, the mastitis is chronic mastitis. In some embodiments, the mastitis is septic mastitis.

One aspect of the present application provides a method of inhibiting bacterial adhesion, invasion, and/or colonization of epithelial cells in an individual comprising administering to the individual an effective amount of any one of the compositions described above. In some embodiments, the epithelial cells are located in a tissue selected from the group consisting of a mammary gland, a mammary canal, a uterus, an ear canal, an oral cavity, an eye, a sinus and skin. In some embodiments, the epithelial cells are located in a mammary gland or a mammary canal. In some embodiments, the individual is a dairy cow.

In some embodiments according to any one of the methods of treating or preventing mastitis or methods of inhibiting bacterial adhesion, invasion, and or colonization of epithelial cells in a mammary gland or mammary canal, the composition is administered intramammarily. In some embodiments, the composition is administered to at least one bacterial infected mammary gland of the individual. In some embodiments, the composition is administered to a teat canal of the individual. In some embodiments, the composition is in contact with the epithelial cells for at least about 4 hours (such as at least about any one of 6 hours, 10 hours, 12 hours, or more).

In some embodiments according to any one of the methods of treating or preventing mastitis or methods of inhibiting bacterial adhesion, invasion, and or colonization of epithelial cells in a mammary gland or mammary canal, the individual is subsequently administered a teat sealant.

In some embodiments according to any one of the methods of treating or preventing mastitis or methods of inhibiting bacterial adhesion, invasion, and or colonization of epithelial cells in a mammary gland or mammary canal, the composition is administered during a lactating period. In some embodiments, the composition is administered during a dry period. In some embodiments, the composition is administered at the beginning of the dry period at cessation of milking. In some embodiments, the composition is administered during a transition period.

In some embodiments according to any one of the methods of treating or preventing mastitis or methods of inhibiting bacterial adhesion, invasion, and or colonization of epithelial cells in a mammary gland or mammary canal, the composition is administered once. In some embodiments, the composition is administered more than once (such as about any one of 2, 3, 4, 5, 6, or more times).

In some embodiments according to any one of the methods of treating or preventing mastitis or methods of inhibiting bacterial adhesion, invasion, and or colonization of epithelial cells in a mammary gland or mammary canal, the effective amount of the composition is at least about $10^6$ PFU (such as at least about any one of $10^7$, $10^8$, $10^9$, $10^{10}$, $10^{11}$ or more PFU).

One aspect of the present application provides a method of inhibiting bacterial growth in a target composition comprising contacting the target composition with an effective amount of any one of the compositions described above. In some embodiments, the target composition is raw milk. In some embodiments, the contacting occurs at more than 25° C.

One aspect of the present application provides a kit comprising any one of the compositions described above and instructions for treating or preventing a disease caused by a bacterial infection. In some embodiments, the kit further comprises a teat sealant. In some embodiments, the kit further comprises a device for intramammary administration. In some embodiments, the device is a syringe.

Also provided are pharmaceutical compositions, kits and articles of manufacture comprising any of the compositions described herein.

These and other aspects and advantages of the present invention will become apparent from the subsequent detailed description and the appended claims. It is to be understood that one, some, or all of the properties of the various embodiments described herein may be combined to form other embodiments of the present invention.

BRIEF DESCRIPTION OF THE DRAWINGS

FIG. 1A shows that 58% of the 36 bacterial isolates from Washington State were completely or partially inhibited by the bacteriophage cocktail. FIG. 1B shows that 54% of the 26 isolates from New York State were completely or partially inhibited by the bacteriophage cocktail.

FIG. 2A shows the mean optical density growth curves of all isolates (n=62). FIG. 2B shows the mean optical density growth curves of isolates (n=28) that were completely inhibited by the bacteriophage cocktail. "Complete inhibition" is defined as a 91-100% decrease in growth at 12 hours. FIG. 2C shows the mean optical density growth curves of isolates (n=7) that were partially inhibited by the bacteriophage cocktail. "Partial inhibition" is defined as a 10-90% decrease at 12 hours. FIG. 2D shows the mean optical density growth curves of isolates (n=27) that were not inhibited by the bacteriophage cocktail. "No inhibition" is defined as a 0-9% decrease at 12 hours.

FIG. 4A shows reduction of adhesion and invasion of MAC-T cells by three persistent *E. coli* strains when pre-treated with the bacteriophage cocktail. Adhesion and invasion levels are expressed as % of bacteria counts relative to the control conditions. FIG. 4B shows survivability of internalized bacterial strain P4 together with bacteriophage, or internalized bacteria P4 without bacteriophage treatment. Bacteria count is shown in logs of colony forming units (CFU). Bacteriophage count is shown in plaque forming units (PFU).

CFU/10 µL value was imputed as 300 for all analysis. Values were converted to CFU/mL and adjusted to account for the LOD (0 CFU/10 µL was converted to 100 CFU/mL) and then log-transformed.

Figures 7A, 7B:
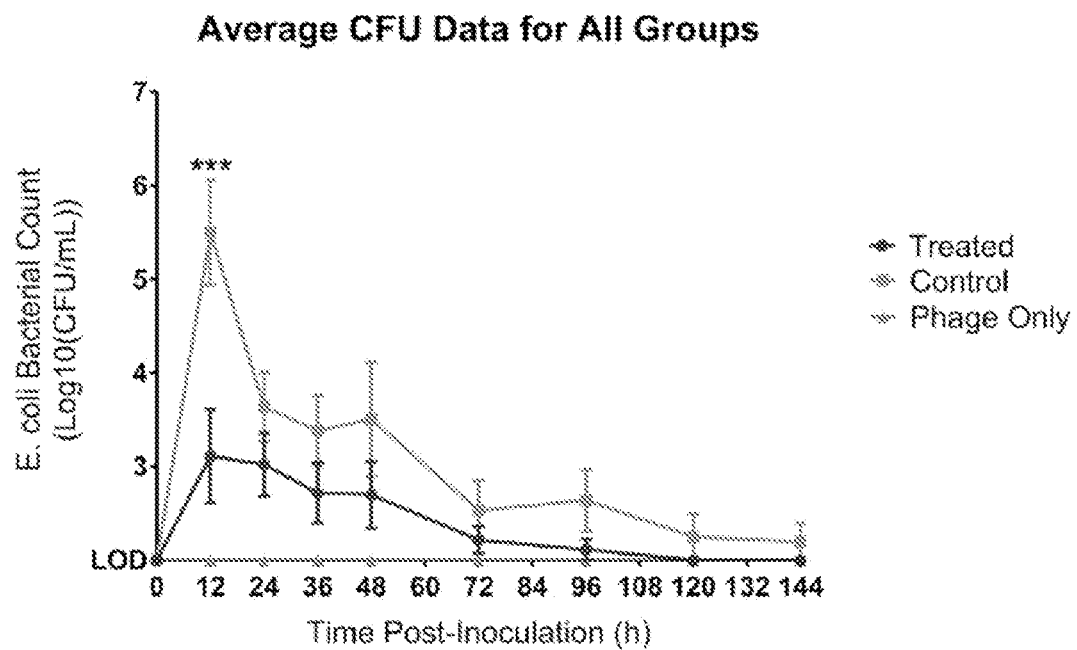
FIG. 7A shows average CFU values in cows of control, phage-treated, and phage only groups. Mean of log transformed CFU/mL values with standard error are shown. *** denotes P-value<0.0001 in treated group vs. control group. All CFU values were reported as CFU/10 Values that were reported as >300 CFU/10 μL were retested in-house, to obtain a more accurate number and were replaced if the retested value was >300 CFU/10 μL. If not, then the >300

FIG. 7B shows statistical analysis of CFU values in the phage-treated and control groups. CFU values were log transformed prior to statistical analysis (i.e. log(CFU/mL)). Back-transformed least squares means are presented. Day 0 was excluded as all values were reported as <100 for E. coli. Repeated measures ANOVA was used as the statistical model. Within time point P-values are provided. Where values were reported as <100, 100 was imputed.

Figures 8A, 8B:
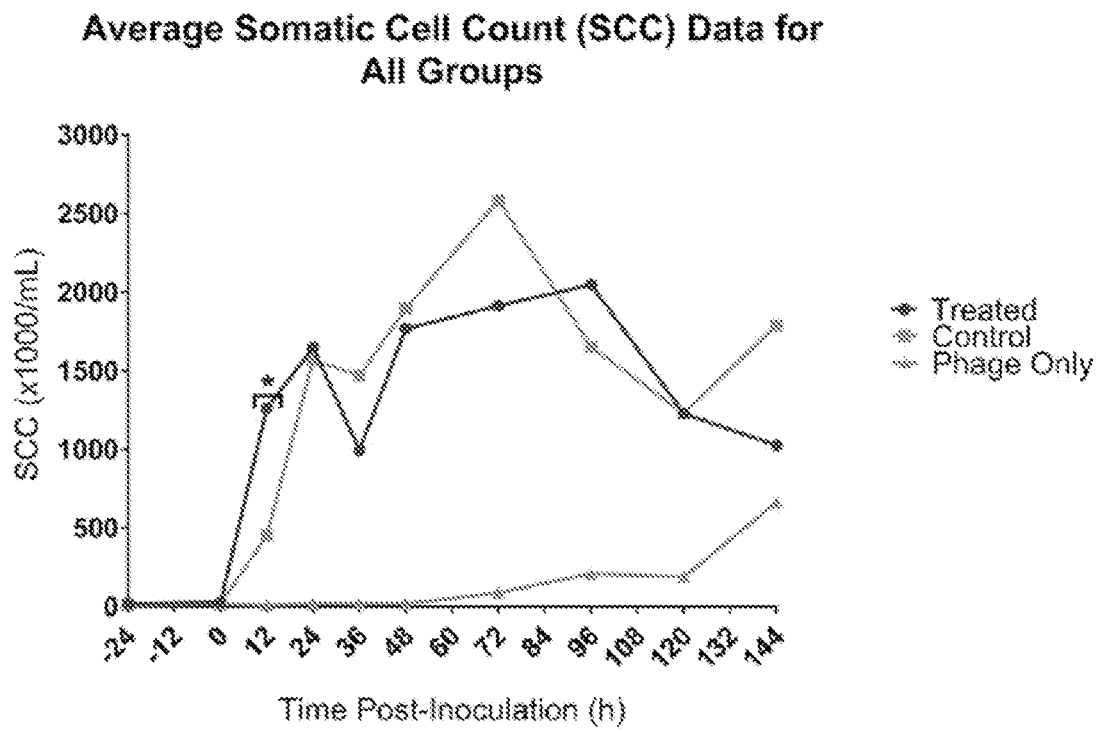

FIG. 8A shows average somatic cell count (SCC) in the control, phage-treated, and phage only groups. One cow in phage-treated group had concurrent Staphylococcus infection, which likely led to increase in SCC at the end of the week tested.

FIG. 8B shows statistical analysis of somatic cell counts in the phage-treated and control groups. SCC values were log transformed prior to statistical analysis (i.e., log(SCC+1)). Back-transformed least squares means are presented. Day 0 was excluded. Repeated measures ANOVA was used as the statistical model. Within time point P-values are provided.

Figures 9A, 9B:
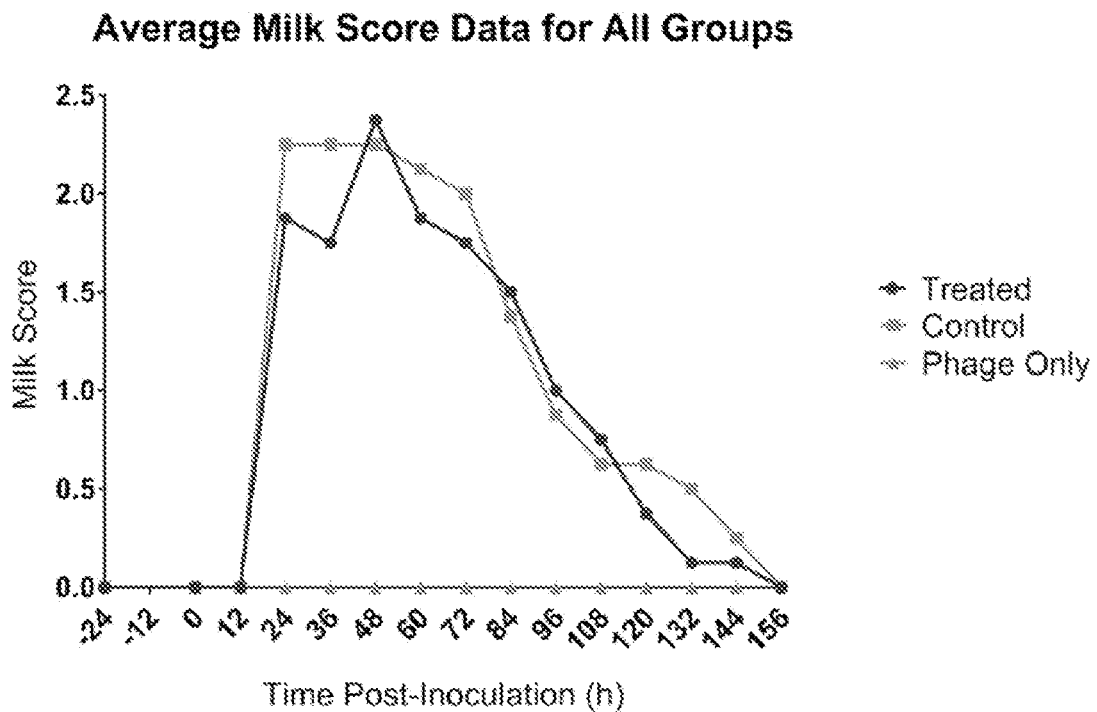

FIG. 9A shows average milk score in the control, phage-treated, and phage only groups.

FIG. 9B shows statistical analysis of average milk score in the phage-treated and control groups. Shown are numbers of cows with score>0 versus total number of cows tested. Fisher's exact test at each time point was used. Within time point P-values are provided.

Figures 10A, 10B:
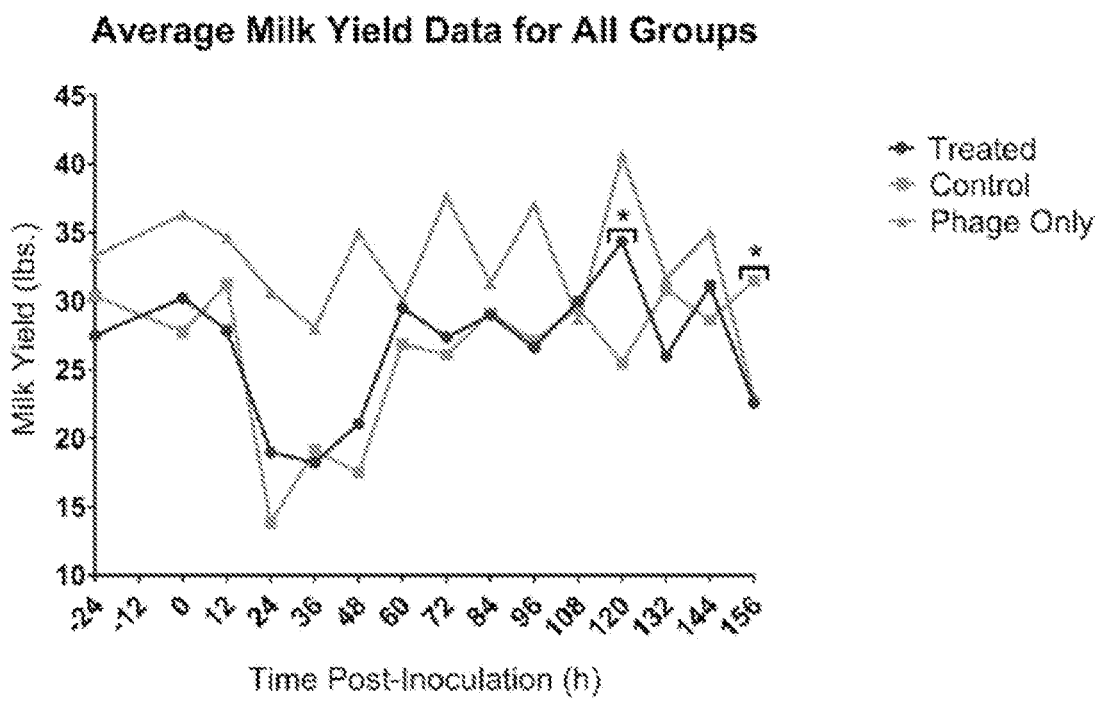

FIG. 10A shows average milk yield in the control, phage-treated, and phage only groups.

FIG. 10B shows statistical analysis of average milk yield in the phage-treated and control groups. Day 0 was excluded. Repeated measures ANOVA was used as the statistical model. Within time point P-values are provided. * denotes p<0.05 in phage-treated group vs. control group.

Figures 11A, 11B:
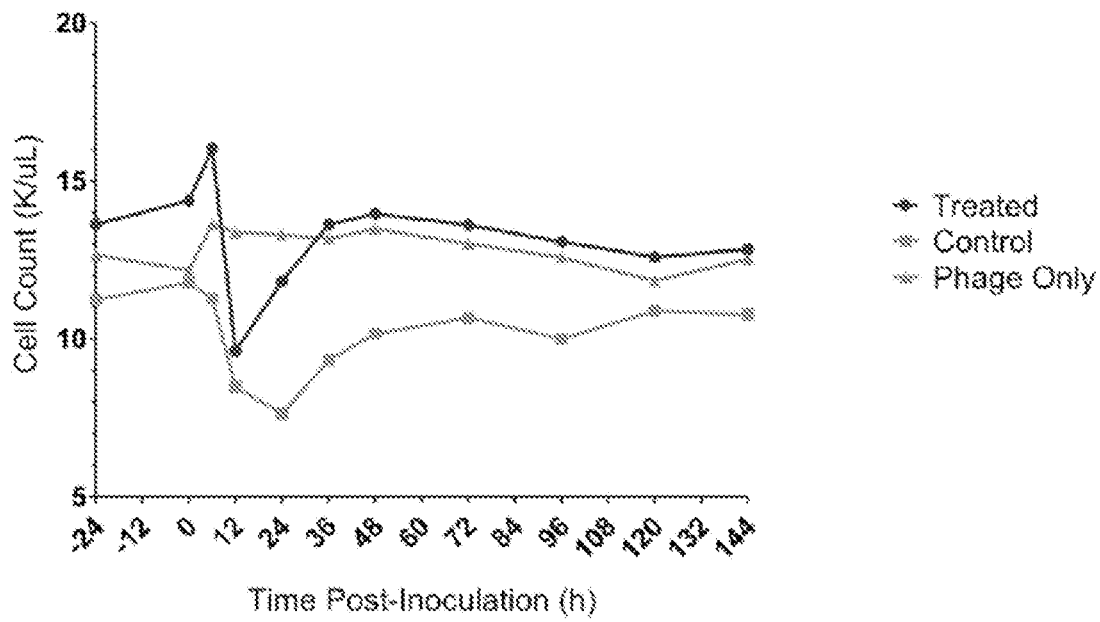

FIG. 11A shows average White Blood Cell (WBC) count in the control, phage-treated, and phage only groups.

FIG. 11B shows statistical analysis of WBC count in the phage-treated and control groups. Repeated measures ANOVA was used as the statistical model. Within time point P-values are provided.

Figures 12A, 12B:
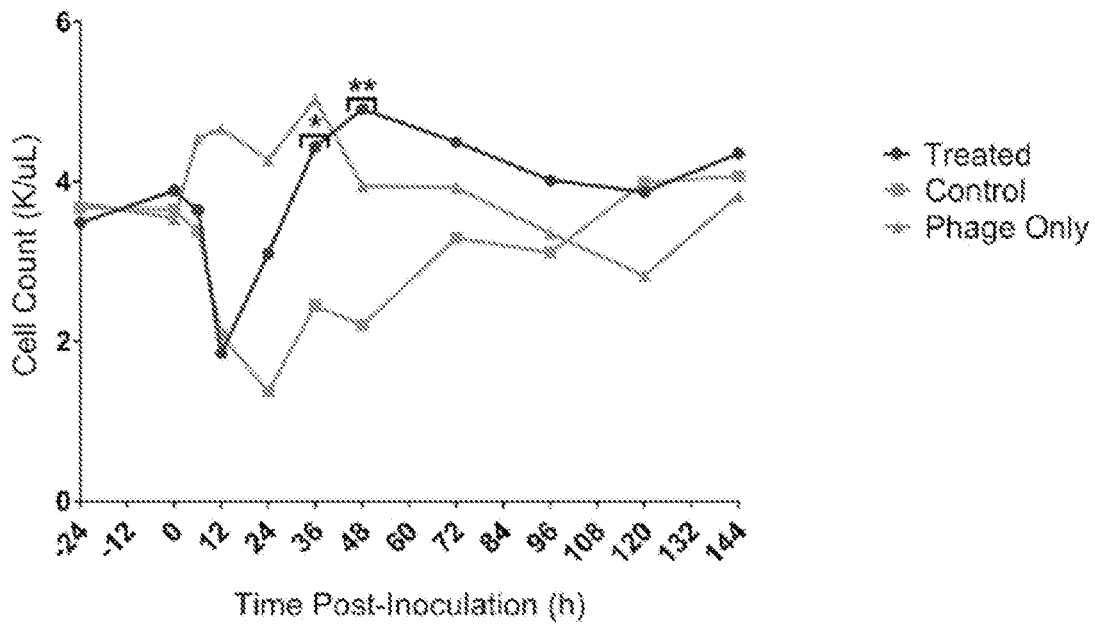

FIG. 12A shows average neutrophil count in the control, phage-treated, and phage only groups.

FIG. 12B shows statistical analysis of neutrophil count in the phage-treated and control groups. Repeated measures ANOVA was used as the statistical model. Within time point P-values are provided. * denotes p<0.05 in phage-treated vs. control group.

FIG. 13A shows average histopathology score per cow in three phage treated cows. Each cow had 10 udder tissue samples taken postmortem. 5 from the phage treated mammary quarter, and 5 from an untreated control quarter. * denotes that 6 samples were taken from the same location in cow 17, and all 6 samples were included in the analysis.

FIG. 13B shows statistical analysis of histopathology scores. The total score from each section within an udder quarter was used as the unit of measure. Udder quarter served as the experimental unit. The effect of treatment on quarter scores was evaluated by ANOVA. The model included treatment group as the only fixed effect. Cow nested within group (i.e. the random effect of tissue section within quarter) was included as a random effect. No treatment effects were detected (P=0.5984).

DETAILED DESCRIPTION OF THE INVENTION

The present application provides compositions comprising a bacteriophage cocktail and a delivery vehicle, and methods of using the compositions against infectious bacteria, such as mastitis-causing bacteria. The bacteriophages described herein were isolated from environmental samples to target clinical isolates of mastitis bacteria, as well as bacteriophage insensitive mutants (BIMs) derived from the clinical isolates. The bacteriophage cocktails were shown to inhibit bacterial growth in liquid medium against a wide range of mastitis E. coli isolates from different geographic locations, and suppress emergence of BIMs. The bacteriophage cocktails are also effective in inhibiting growth of persistent E. coli strains in raw milk, and inhibiting adhesion and invasion of chronic mastitis E. coli strains to mammary epithelial cells in vitro. In some embodiments, the delivery vehicle is suitable for intramammary infusion or application as an intramammary ointment. Proof-of-concept field tests in dairy cows have demonstrated that the bacteriophage compositions were effective in reducing E. coli that could cause persistent mastitis. The present application further discloses compositions comprising one or more bacteriophages against Gram-negative bacteria and one or more bacteriophages against Gram-positive bacteria. In some embodiments, the present application provides an efficient, safe treatment for preventing, controlling, treating and reversing mastitis in dairy cows during lactation, onset of the dry period and during the dry period without negatively affecting both milk yield and quality. Use of the bacteriophage compositions described herein on dairy cows may provide the benefit of eliminating excessive use and dependence of antibiotics in the dairy industry.

Accordingly, one aspect of the present application provides a composition comprising one or more (such as at least 2, 3, 4, or 5) bacteriophages and a delivery vehicle, wherein the one or more bacteriophages target Escherichia coli, and wherein the one or more bacteriophages comprise genome sequences having at least about 95% (such as 100%) sequence identity to the genome sequences of one or more bacteriophages selected from the group consisting of p0031, p0032, p0033, p0034, and p0045. In some embodiments, the one or more bacteriophages are selected from the group consisting of p0031, p0032, p0033, p0034, and p0045.

One aspect of the present application provides a method of treating or preventing a disease (such as mastitis) caused by a bacterial infection in an individual comprising administering to the individual an effective amount of a composition comprising one or more (such as at least 2, 3, 4, or 5) bacteriophages and a delivery vehicle, wherein the one or more bacteriophages target Escherichia coli, and wherein the one or more bacteriophages comprise genome sequences having at least about 95% (such as 100%) sequence identity to the genome sequences of one or more bacteriophage selected from the group consisting of p0031, p0032, p0033, p0034, and p0045. In some embodiments, the one or more bacteriophages are selected from the group consisting of p0031, p0032, p0033, p0034, and p0045.

One aspect of the present application provides a method of inhibiting bacterial adhesion, invasion, and/or colonization of epithelial cells in an individual comprising administering to the individual an effective amount of a composition comprising one or more (such as at least 2, 3, 4, or 5)

bacteriophages and a delivery vehicle, wherein the one or more bacteriophages target *Escherichia coli*, and wherein the one or more bacteriophages comprises genome sequences having at least about 95% (such as 100%) sequence identity to the genome sequences of one or more bacteriophages selected from the group consisting of p0031, p0032, p0033, p0034, and p0045. In some embodiments, the one or more bacteriophages are selected from the group consisting of p0031, p0032, p0033, p0034, and p0045.

Also provided are kits and articles manufacture useful for the methods described herein.

I. Definitions

Terms are used herein as generally used in the art, unless otherwise defined as follows.

"Antibacterial" refers to anything that is destructive to or inhibits the growth of bacteria.

As used herein, "bacterium" refers to a bacterium isolate in which members of the isolate has substantially the same genetic makeup, such as sharing at least about any of 90%, 95%, 99%, 99.9% or more sequence identity in their genome. "Bacterium" may refer to the same bacterium genus, species, strain, or clone. "Bacterium" refers to the parent bacterium as well as the progeny or derivatives (such as genetically engineered versions) thereof.

As used herein, "bacteriophage" and "phage" are used interchangeably to refer to a bacteriophage isolate in which members of the isolate has substantially the same genetic makeup, such as sharing at least about any of 90%, 95%, 99%, 99.9% or more sequence identity in the genome. "Bacteriophage" or "phage" refers to the parent bacteriophage as well as the progeny or derivatives (such as genetically engineered versions) thereof. The bacteriophage can be a naturally occurring phage isolate, or an engineered phage, including vectors, or nucleic acids that encode at least all essential genes, or the full genome of a phage to carry out the life cycle of the phage inside a host bacterium.

As used herein, a bacteriophage "targeting" or "targets" a bacterium means that the bacteriophage can infect the bacterium, and inhibit the growth of the bacterium. The bacteriophage can be either a lysogenic bacteriophage of the bacterium, or a lytic bacteriophage of the bacterium. "Host range" of a bacteriophage refers to the number of bacteria that can be targeted by the bacteriophage.

As used herein, a "bacteriophage insensitive mutant" or "BIM" refers to a derivative of a bacterium that belongs to the same species as the bacterium, but has one or more mutations in its genome so that one or more bacteriophages that can target the bacterium can no longer target the BIM.

As used herein, "bacteriophage cocktail" refers to a composition having two or more bacteriophages.

As used herein, the term "bacterial infection" can refer to a disease caused by a bacterium that invades an organism's tissue, including the bacterium's adhesion to the cells of the tissue, invasion (i.e., internalization) of the bacterium by the cells of the tissue, colonization of the bacterium intracellularly or on the surface of the tissue, growth or multiplication of the bacterium intracellularly or on the surface of the tissue, and/or the organism's reaction to the bacterium and any toxins produced by the bacterium.

As used herein, "treatment" or "treating" refers to an approach for obtaining beneficial or desired results including clinical results. For purposes of this invention, beneficial or desired clinical results include, but are not limited to, one or more of the following: alleviating one or more symptoms resulting from the disease, diminishing the extent of the disease, stabilizing the disease (e.g., preventing or delaying the worsening of the disease), preventing or delaying the spread of the disease, delaying or slowing the progression of the disease, ameliorating the disease state, and decreasing the dose of one or more other medications required to treat the disease. The methods of the invention contemplate any one or more of these aspects of treatment.

As used herein, "delaying development of a disease" means to defer, hinder, slow, retard, stabilize, suppress and/or postpone development of the disease. This delay can be of varying lengths of time, depending on the history of the disease and/or individual being treated. As is evident to one skilled in the art, a sufficient or significant delay can, in effect, encompass prevention, in that the individual does not develop the disease.

As used herein, "prevent" or "preventing" includes providing prophylaxis with respect to the occurrence or recurrence of a disease in a subject that may be predisposed to the disease but has not yet been diagnosed with the disease.

As used herein, "individual" or "subject" refers to an animal, lactating or non-lactating, including, but not limited to, a cow, a goat, a sheep, a buffalo, a camel, a donkey, a llama, a horse, a pig, a human, a primate, an avian, a fish, a mule, a cat and a dog. The individual can benefit from bacteriophage therapy for the treatment or prevention of a bacterial infection. In some embodiments, the individual is a human. In some embodiments, the individual is a farm animal, for example a dairy cow.

An "effective amount" refers to an amount effective, at dosages and for periods of time necessary, to achieve the desired therapeutic or prophylactic result. An effective amount is also one in which any toxic or detrimental effects of the treatment are outweighed by the therapeutically beneficial effects. For prophylactic use, beneficial or desired results include results such as eliminating or reducing the risk, lessening the severity, or delaying the onset of the disease, including biochemical, histological and/or behavioral symptoms of the disease, its complications and intermediate pathological phenotypes presenting during development of the disease. For therapeutic use, beneficial or desired results include clinical results such as decreasing one or more symptoms resulting from the disease, increasing the quality of life of those suffering from the disease, decreasing the dose of other medications required to treat the disease, enhancing effect of another medication such as via targeting, delaying the progression of the disease, and/or prolonging survival. An effective amount can be provided in one or more administrations. In the case of treating bacterial infections, an effective amount is an amount of an agent or a composition sufficient to cause an effect on the growth of the bacteria. The effective amount of the antibacterial agent or composition, when used alone or in combination, may: (i) reduce the number of bacterial cells; (ii) inhibit, retard, slow to some extent and preferably stop bacteria proliferation; (iii) inhibit bacteria growth; (iv) inhibit adhesion of bacterial cells to host cells; (v) inhibit invasion of bacterial cells into the host cells; (vi) inhibit colonization of bacterial cells into host cells or tissues; (vii) prevent or delay occurrence and/or recurrence of bacterial infection; and/or (viii) relieve to some extent one or more of the symptoms associated with the bacterial infection.

The terms "inhibition" or "inhibit" refer to a decrease or cessation of any phenotypic characteristic or to the decrease or cessation in the incidence, degree, or likelihood of that characteristic. To "reduce" or "inhibit" is to decrease, reduce or arrest an activity, function, and/or amount as compared to a reference. In some embodiments, by "reduce" or "inhibit"

is meant the ability to cause an overall decrease of 10% or greater. In another embodiment, by "reduce" or "inhibit" is meant the ability to cause an overall decrease of 50% or greater. In yet another embodiment, by "reduce" or "inhibit" is meant the ability to cause an overall decrease of 75%, 85%, 90%, 95%, or greater.

A "reference" as used herein, refers to any sample, standard, or level that is used for comparison purposes. A reference may be obtained from a healthy and/or non-diseased sample. In some examples, a reference may be obtained from an untreated sample. In some examples, a reference is obtained from a non-diseased on non-treated sample of an individual. In some examples, a reference is obtained from one or more healthy individuals who are not the subject or patient.

As used herein the term "dry period" can refer to the phase in a dairy animal before parturition in which lactation has ceased. According to present practices in the dairy industry, involution and subsequent cessation of milk production can occur by initiating the dry period, after which time the milk secretion capacity can be restored at the time of parturition. Currently, the length of dry period can typically be between 45 to 70 days in a bovid.

As used herein, the term "cessation of milk production" can refer to transient cessation as well as to persistent cessation of milk production. Transient cessation of milk production can refer to reversible cessation of milk production. Persistent cessation can refer to interruption in lactation that can be reversible only by parturition following pregnancy and by sexual hormonal treatment.

As used herein, the ter "beginning of the dry period" can refer to the dry period, typically about 60 days, in a cow, before an expected parturition.

As used herein, the term "transition period" refers to a period of time beginning from the last three weeks prior to parturition through the first three weeks following parturition. During this time, a cow can be immunosuppressed and can have increased susceptibility to developing mastitis though symptoms can evade detection.

It is understood that aspects and embodiments of the invention described herein include "consisting" and/or "consisting essentially of" aspects and embodiments.

Where a range of values is provided, it is understood that each intervening value, to the tenth of the unit of the lower limit unless the context clearly dictates otherwise, between the upper and lower limit of that range and any other stated or intervening value in that stated range, is encompassed within embodiments of the present disclosure. The upper and lower limits of these smaller ranges may independently be included in the smaller ranges and are also encompassed within embodiments of the present disclosure, subject to any specifically excluded limit in the stated range. Where the stated range includes one or both of the limits, ranges excluding either or both of those included limits are also included in embodiments of the present disclosure.

Reference to "about" a value or parameter herein includes (and describes) variations that are directed to that value or parameter per se. For example, description referring to "about X" includes description of "X".

As used herein, reference to "not" a value or parameter generally means and describes "other than" a value or parameter.

The term "about X-Y" used herein has the same meaning as "about X to about Y."

As used herein and in the appended claims, the singular forms "a," "or," and "the" include plural referents unless the context clearly dictates otherwise.

II. Bacteriophage Compositions

One aspect of the present application provides compositions comprising one or more bacteriophages. In some embodiments, the present application provides a composition comprising one or more bacteriophages and a delivery vehicle.

The bacteriophages can be naturally occurring, or engineered derivatives thereof. In some embodiments, the one or more bacteriophages are isolated from different sources. For example, exemplary bacteriophage p0031, p0032, p0033, and p0034 (also known as MEV11, MEV12, MEV21, and ME22 respectively) were isolated from samples of the primary effluent of wastewater from a sewage treatment plant in Olympia, Wash. Exemplary bacteriophage p0045 was isolated from a sewage effluent environmental sample collected from Silicon Valley Clean Water (SVCW). Exemplary bacteriophage p0014 (also known as Stab8) was isolated from a primary sewage water discharge obtained from the sewage treatment plant located about 3 Km from the center of the city of Shkoder (Albania). In some embodiments, the one or more bacteriophages do not co-exist in nature. In some embodiments, the one or more bacteriophages are not naturally present in the delivery vehicle. The present invention discovered that compositions comprising any one or combination of bacteriophages p0031, p0032, p0033, p0034 and p0045 and a delivery vehicle are particularly effective in treating bacterial infections caused by clinical isolates of *E. coli* and their bacteriophage-insensitive mutants. However, the compositions described herein are not limited to single bacteriophage compositions or cocktails comprising bacteriophages selected from p0031, p0032, p0033, p0034 and p0045 only.

In some embodiments, there is provided a composition comprising a bacteriophage and a delivery vehicle, wherein the bacteriophage targets *Escherichia coli*, and wherein the bacteriophage comprises a genome sequence having at least about 95% (such as 100%) sequence identity to the genome sequence of a bacteriophage selected from the group consisting of p0031, p0032, p0033, p0034, and p0045. In some embodiments, the bacteriophage comprises a genome sequence having at least about 95% (such as at least about any one of 96%, 97%, 98%, 99%, 99.5%, 99.9% or more, or 100%) sequence identity to the genome sequence of p0031. In some embodiments, the bacteriophage comprises a genome sequence having at least about 95% (such as at least about any one of 96%, 97%, 98%, 99%, 99.5%, 99.9% or more, or 100%) sequence identity to the genome sequence of p0032. In some embodiments, the bacteriophage comprises a genome sequence having at least about 95% (such as at least about any one of 96%, 97%, 98%, 99%, 99.5%, 99.9% or more, or 100%) sequence identity to the genome sequence of p0033. In some embodiments, the bacteriophage comprises a genome sequence having at least about 95% (such as at least about any one of 96%, 97%, 98%, 99%, 99.5%, 99.9% or more, or 100%) sequence identity to the genome sequence of p0034. In some embodiments, the bacteriophage comprises a genome sequence having at least about 95% (such as at least about any one of 96%, 97%, 98%, 99%, 99.5%, 99.9% or more, or 100%) sequence identity to the genome sequence of p0045. In some embodiments, the composition comprises at least two bacteriophages. In some embodiments, the composition comprises at least three bacteriophages. In some embodiments, the composition comprises at least four bacteriophages. In some embodiments, the composition comprises at least five bacteriophages. In some embodiments, the *E. coli* is a clinical isolate of *E. coli*. In some embodiments, the *E. coli* causes a bacterial infection, such as mastitis. In some embodiments, the *E. coli* is a persistent *E. coli* strain. In some embodiments, the *E. coli* is a transient *E. coli* strain. In some embodiments, the *E. coli* is a BIM. In some embodiments, the delivery vehicle is suitable for intramammary administration. In some embodiments, the delivery vehicle is an ointment, such as a teat sealant. In some embodiments, the delivery vehicle is suitable for oral administration. In some embodiments, the delivery vehicle is suitable for parenteral administration. In some embodiments, the delivery vehicle is not water.

In some embodiments, there is provided a composition comprising a bacteriophage and a delivery vehicle, wherein the bacteriophage targets *Escherichia coli*, and wherein the bacteriophage comprises a genome sequence having at least about 95% (such as at least about any one of 96%, 97%, 98%, 99%, 99.5%, 99.9% or more, or 100%) sequence identity to a genome sequence selected from the group consisting of SEQ ID NOs: 1-5. In some embodiments, the bacteriophage comprises a genome sequence having at least about 95% (such as at least about any one of 96%, 97%, 98%, 99%, 99.5%, 99.9% or more, or 100%) sequence identity to the genome sequence of SEQ ID NO: 1. In some embodiments, the bacteriophage comprises a genome sequence having at least about 95% (such as at least about any one of 96%, 97%, 98%, 99%, 99.5%, 99.9% or more, or 100%) sequence identity to the genome sequence of SEQ ID NO: 2. In some embodiments, the bacteriophage comprises a genome sequence having at least about 95% (such as at least about any one of 96%, 97%, 98%, 99%, 99.5%, 99.9% or more, or 100%) sequence identity to the genome sequence of SEQ ID NO: 3. In some embodiments, the bacteriophage comprises a genome sequence having at least about 95% (such as at least about any one of 96%, 97%, 98%, 99%, 99.5%, 99.9% or more, or 100%) sequence identity to the genome sequence of SEQ ID NO: 4. In some embodiments, the bacteriophage comprises a genome sequence having at least about 95% (such as at least about any one of 96%, 97%, 98%, 99%, 99.5%, 99.9% or more, or 100%) sequence identity to the genome sequence of SEQ ID NO: 5. In some embodiments, the composition comprises at least two bacteriophages. In some embodiments, the composition comprises at least three bacteriophages. In some embodiments, the composition comprises at least four bacteriophages. In some embodiments, the composition comprises at least five bacteriophages. In some embodiments, the *E. coli* is a clinical isolate of *E. coli*. In some embodiments, the *E. coli* causes a bacterial infection, such as mastitis. In some embodiments, the *E. coli* is a persistent *E. coli* strain. In some embodiments, the *E. coli* is a transient *E. coli* strain. In some embodiments, the *E. coli* is a BIM. In some embodiments, the delivery vehicle is suitable for intramammary administration. In some embodiments, the delivery vehicle is an ointment, such as a teat sealant. In some embodiments, the delivery vehicle is suitable for oral administration. In some embodiments, the delivery vehicle is suitable for parenteral administration. In some embodiments, the delivery vehicle is not water.

In some embodiments, there is provided a composition comprising a bacteriophage and a delivery vehicle, wherein the bacteriophage targets *Escherichia coli*, and wherein the bacteriophage is selected from the group consisting of p0031, p0032, p0033, p0034, and p0045. In some embodiments, there is provided a composition comprising bacteriophage p0031 and a delivery vehicle. In some embodiments, there is provided a composition comprising bacteriophage p0032 and a delivery vehicle. In some embodiments, there is provided a composition comprising bacteriophage p0033 and a delivery vehicle. In some embodiments, there is provided a composition comprising bacteriophage p0034 and a delivery vehicle. In some embodiments, there is provided a composition comprising bacteriophage p0045 and a delivery vehicle. In some embodiments, the composition comprises at least two bacteriophages. In some embodiments, the composition comprises at least three bacteriophages. In some embodiments, the composition comprises at least four bacteriophages. In some embodiments, the composition comprises at least five bacteriophages. In some embodiments, the *E. coli* is a clinical isolate of *E. coli*. In some embodiments, the *E. coli* causes a bacterial infection, such as mastitis. In some embodiments, the *E. coli* is a persistent *E. coli* strain. In some embodiments, the *E. coli* is a transient *E. coli* strain. In some embodiments, the *E. coli* is a BIM. In some embodiments, the delivery vehicle is suitable for intramammary administration. In some embodiments, the delivery vehicle is an ointment, such as a teat sealant. In some embodiments, the delivery vehicle is suitable for oral administration. In some embodiments, the delivery vehicle is suitable for parenteral administration. In some embodiments, the delivery vehicle is not water.

In some embodiments, there is provided a composition comprising a T4-like bacteriophage, a second bacteriophage, and a delivery vehicle, wherein the second bacteriophage comprises a genome sequence having at least about 95% (such as at least about any one of 96%, 97%, 98%, 99%, 99.5%, 99.9% or more, or 100%) sequence identity to the genome sequence of p0032, p0033, or p0034. In some embodiments, the second bacteriophage comprises a genome sequence having at least about 95% (such as at least about any one of 96%, 97%, 98%, 99%, 99.5%, 99.9% or more, or 100%) sequence identity to SEQ ID NO: 2, SEQ ID NO: 3, or SEQ ID NO: 4. In some embodiments, the second bacteriophage is p0032, p0033, or p0034. In some embodiments, the T4-like bacteriophage and the second bacteriophage target *Escherichia coli*. In some embodiments, the *E. coli* is a clinical isolate of *E. coli*. In some embodiments, the *E. coli* causes a bacterial infection, such as mastitis. In some embodiments, the *E. coli* is a persistent *E. coli* strain. In some embodiments, the *E. coli* is a transient *E. coli* strain. In some embodiments, the composition further comprises a bacteriophage targeting a BIM of the *E. coli*, wherein the BIM is not targeted by the T4-like bacteriophage, or the second bacteriophage. In some embodiments, the bacteriophage targeting the BIM is p0045. In some embodiments, the delivery vehicle is suitable for intramammary administration. In some embodiments, the delivery vehicle is an ointment, such as a teat sealant. In some embodiments, the delivery vehicle is suitable for oral administration. In some embodiments, the delivery vehicle is suitable for parenteral administration. In some embodiments, the delivery vehicle is not water.

In some embodiments, there is provided a composition comprising a Schizo-T4-like bacteriophage, a second bacteriophage, and a delivery vehicle, wherein the second bacteriophage comprises a genome sequence having at least about 95% (such as at least about any one of 96%, 97%, 98%, 99%, 99.5%, 99.9% or more, or 100%) sequence identity to the genome sequence of p0031, p0033 or p0034. In some embodiments, the second bacteriophage comprises a genome sequence having at least about 95% (such as at least about any one of 96%, 97%, 98%, 99%, 99.5%, 99.9% or more, or 100%) sequence identity to SEQ ID NO: 1, SEQ ID NO: 3, or SEQ ID NO: 4. In some embodiments, the second bacteriophage is p0031, p0033 or p0034. In some embodiments, the Schizo-T4-like bacteriophage and the second bacteriophage target *Escherichia coli*. In some embodiments, the *E. coli* is a clinical isolate of *E. coli*. In some embodiments, the *E. coli* causes a bacterial infection, such as mastitis. In some embodiments, the *E. coli* is a persistent *E. coli* strain. In some embodiments, the *E. coli* is a transient *E. coli* strain. In some embodiments, the composition further comprises a bacteriophage targeting a BIM of the *E. coli*, wherein the BIM is not targeted by the Schizo-T4-like bacteriophage, or the second bacteriophage. In some embodiments, the bacteriophage targeting the BIM is p0045. In some embodiments, the delivery vehicle is suitable for intramammary administration. In some embodiments, the delivery vehicle is an ointment, such as a teat sealant. In some embodiments, the delivery vehicle is suitable for oral administration. In some embodiments, the delivery vehicle is suitable for parenteral administration. In some embodiments, the delivery vehicle is not water.

In some embodiments, there is provided a composition comprising a rV5-related and phi92-related bacteriophage, a second bacteriophage, and a delivery vehicle, wherein the second bacteriophage comprises a genome sequence having at least about 95% (such as at least about any one of 96%, 97%, 98%, 99%, 99.5%, 99.9% or more, or 100%) sequence identity to the genome sequence of p0031 or p0032. In some embodiments, the second bacteriophage comprises a genome sequence having at least about 95% (such as at least about any one of 96%, 97%, 98%, 99%, 99.5%, 99.9% or more, or 100%) sequence identity to SEQ ID NO: 1 or SEQ ID NO: 2. In some embodiments, the second bacteriophage is p0031 or p0032. In some embodiments, the composition comprises two rV5-related and phi92-related bacteriophages. In some embodiments, the rV5-related and phi92-related bacteriophage and the second bacteriophage target *Escherichia coli*. In some embodiments, the *E. coli* is a clinical isolate of *E. coli*. In some embodiments, the *E. coli* causes a bacterial infection, such as mastitis. In some embodiments, the *E. coli* is a persistent *E. coli* strain. In some embodiments, the *E. coli* is a transient *E. coli* strain. In some embodiments, the composition further comprises a bacteriophage targeting a BIM of the *E. coli*, wherein the BIM is not targeted by the rV5-related and phi92-related bacteriophage or the second bacteriophage. In some embodiments, the bacteriophage targeting the BIM is p0045. In some embodiments, the delivery vehicle is suitable for intramammary administration. In some embodiments, the delivery vehicle is an ointment, such as a teat sealant. In some embodiments, the delivery vehicle is suitable for oral administration. In some embodiments, the delivery vehicle is suitable for parenteral administration. In some embodiments, the delivery vehicle is not water.

In some embodiments, there is provided a composition comprising a first bacteriophage, a second bacteriophage, and a delivery vehicle, wherein the second bacteriophage targets *E. coli*, wherein the first bacteriophage targets a BIM of the *E. coli*, and wherein the second bacteriophage is selected from the group consisting of a T4-like bacteriophage, a Schizo-T4-like bacteriophage, and a rV5-related and phi92-related bacteriophage. In some embodiments, the first bacteriophage comprises a genome sequence having at least about 95% (such as at least about any one of 96%, 97%, 98%, 99%, 99.5%, 99.9% or more) sequence identity to the genome sequence of p0045. In some embodiments, the first bacteriophage comprises a genome sequence having at least about 95% (such as at least about any one of 96%, 97%, 98%, 99%, 99.5%, 99.9% or more) sequence identity to SEQ ID NO: 5. In some embodiments, the first bacteriophage is p0045. In some embodiments, the second bacteriophage comprises a genome sequence having at least about 95% (such as at least about any one of 96%, 97%, 98%, 99%, 99.5%, 99.9% or more, or 100%) sequence identity to the genome sequence of a bacteriophage selected from the group consisting of p0031, p0033, p0032, and p0034. In some embodiments, the second bacteriophage comprises a genome sequence having at least about 95% (such as at least about any one of 96%, 97%, 98%, 99%, 99.5%, 99.9% or more, or 100%) sequence identity to a genome sequence selected from the group consisting of SEQ ID NOs: 1-4. In some embodiments, the second bacteriophage is selected from the group consisting of p0031, p0033, p0032, and p0034. In some embodiments, the delivery vehicle is suitable for intramammary administration. In some embodiments, the delivery vehicle is an ointment, such as a teat sealant. In some embodiments, the delivery vehicle is suitable for oral administration. In some embodiments, the delivery vehicle is suitable for parenteral administration. In some embodiments, the delivery vehicle is not water.

In some embodiments, there is provided a composition comprising a T4-like bacteriophage, a Schizo-T4-like bacteriophage, a third bacteriophage, and a delivery vehicle, wherein the third bacteriophage comprises a genome sequence having at least about 95% (such as at least about any one of 96%, 97%, 98%, 99%, 99.5%, 99.9% or more, or 100%) sequence identity to the genome sequence of p0033 or p0034. In some embodiments, the second bacteriophage comprises a genome sequence having at least about 95% (such as at least about any one of 96%, 97%, 98%, 99%, 99.5%, 99.9% or more, or 100%) sequence identity to SEQ ID NO: 3 or SEQ ID NO: 4. In some embodiments, the third bacteriophage is p0033 or p0034. In some embodiments, the composition comprises both p0033 and p0034. In some embodiments, the T4-like bacteriophage, and the Schizo-T4-like bacteriophage and the third bacteriophage target *Escherichia coli*. In some embodiments, the *E. coli* is a clinical isolate of *E. coli*. In some embodiments, the *E. coli* causes a bacterial infection, such as mastitis. In some embodiments, the *E. coli* is a persistent *E. coli* strain. In some embodiments, the *E. coli* is a transient *E. coli* strain. In some embodiments, the composition further comprises a bacteriophage targeting a BIM of the *E. coli*, wherein the BIM is not targeted by the T4-like bacteriophage, the Schizo-T4-like bacteriophage, or the third bacteriophage. In some embodiments, the bacteriophage targeting the BIM is p0045. In some embodiments, the delivery vehicle is suitable for intramammary administration. In some embodiments, the delivery vehicle is an ointment, such as a teat sealant. In some embodiments, the delivery vehicle is suitable for oral administration. In some embodiments, the delivery vehicle is suitable for parenteral administration. In some embodiments, the delivery vehicle is not water.

In some embodiments, there is provided a composition comprising a T4-like bacteriophage, a rV5-related and phi92-related bacteriophage, a third bacteriophage, and a delivery vehicle, wherein the third bacteriophage comprises a genome sequence having at least about 95% (such as at least about any one of 96%, 97%, 98%, 99%, 99.5%, 99.9% or more, or 100%) sequence identity to the genome sequence of p0032. In some embodiments, the second bacteriophage comprises a genome sequence having at least about 95% (such as at least about any one of 96%, 97%, 98%, 99%, 99.5%, 99.9% or more, or 100%) sequence identity to SEQ ID NO: 2. In some embodiments, the third bacteriophage is p0032. In some embodiments, the composition comprises two rV5-related and phi92-related bacteriophages. In some embodiments, the T4-like bacteriophage, and the rV5-related and phi92-related bacteriophage and the third bacteriophage target *Escherichia coli*. In some embodiments, the *E. coli* is a clinical isolate of *E. coli*. In some embodiments, the *E. coli* causes a bacterial infection, such as mastitis. In some embodiments, the *E. coli* is a persistent *E. coli* strain. In some embodiments, the *E. coli* is a transient *E. coli* strain. In some embodiments, the composition further comprises a bacteriophage targeting a BIM of the *E. coli*, wherein the BIM is not targeted by the T4-like bacteriophage, the rV5-related and phi92-related bacteriophage, or the third bacteriophage. In some embodiments, the bacteriophage targeting the BIM is p0045. In some embodiments, the delivery vehicle is suitable for intramammary administration. In some embodiments, the delivery vehicle is an ointment, such as a teat sealant. In some embodiments, the delivery vehicle is suitable for oral administration. In some embodiments, the delivery vehicle is suitable for parenteral administration. In some embodiments, the delivery vehicle is not water.

In some embodiments, there is provided a composition comprising a Schizo-T4-like bacteriophage, a rV5-related and phi92-related bacteriophage, a third bacteriophage, and a delivery vehicle, wherein the third bacteriophage comprises a genome sequence having at least about 95% (such as at least about any one of 96%, 97%, 98%, 99%, 99.5%, 99.9% or more, or 100%) sequence identity to the genome sequence of p0031. In some embodiments, the second bacteriophage comprises a genome sequence having at least about 95% (such as at least about any one of 96%, 97%, 98%, 99%, 99.5%, 99.9% or more, or 100%) sequence identity to SEQ ID NO: 1. In some embodiments, the third bacteriophage is p0031. In some embodiments, the Schizo-T4-like bacteriophage, and the rV5-related and phi92-related bacteriophage and the third bacteriophage target *Escherichia coli*. In some embodiments, the *E. coli* is a clinical isolate of *E. coli*. In some embodiments, the *E. coli* causes a bacterial infection, such as mastitis. In some embodiments, the *E. coli* is a persistent *E. coli* strain. In some embodiments, the *E. coli* is a transient *E. coli* strain. In some embodiments, the composition further comprises a bacteriophage targeting a BIM of the *E. coli*, wherein the BIM is not targeted by the Schizo-T4-like bacteriophage, the rV5-related and phi92-related bacteriophage, or the third bacteriophage. In some embodiments, the bacteriophage targeting the BIM is p0045. In some embodiments, the delivery vehicle is suitable for intramammary administration. In some embodiments, the delivery vehicle is an ointment, such as a teat sealant. In some embodiments, the delivery vehicle is suitable for oral administration. In some embodiments, the delivery vehicle is suitable for parenteral administration. In some embodiments, the delivery vehicle is not water.

In some embodiments, there is provided a composition comprising a T4-like bacteriophage, a Schizo-T4-like bacteriophage, an rV5-related and phi92-related bacteriophage, and a delivery vehicle. In some embodiments, the T4-like bacteriophage, the Schizo-T4-like bacteriophage, and the rV5-related and phi92-related bacteriophage target *Escherichia coli*. In some embodiments, the *E. coli* is a clinical isolate of *E. coli*. In some embodiments, the *E. coli* causes a bacterial infection, such as mastitis. In some embodiments, the *E. coli* is a persistent *E. coli* strain. In some embodiments, the *E. coli* is a transient *E. coli* strain. In some embodiments, the composition further comprises a bacteriophage targeting a BIM of the *E. coli*, wherein the BIM is not targeted by the T4-like bacteriophage, the Schizo-T4-like bacteriophage, or the rV5-related and phi92-related bacteriophage. In some embodiments, the bacteriophage targeting the BIM is p0045. In some embodiments, the delivery vehicle is suitable for intramammary administration. In some embodiments, the delivery vehicle is an ointment, such as a teat sealant. In some embodiments, the delivery vehicle is suitable for oral administration. In some embodiments, the delivery vehicle is suitable for parenteral administration. In some embodiments, the delivery vehicle is not water.

In some embodiments, there is provided a composition comprising a T4-like bacteriophage, a Schizo-T4-like bacteriophage, two rV5-related and phi92-related bacteriophages, and a delivery vehicle. In some embodiments, the T4-like bacteriophage, the Schizo-T4-like bacteriophage, and the two rV5-related and phi92-related bacteriophages target *Escherichia coli*. In some embodiments, the *E. coli* is a clinical isolate of *E. coli*. In some embodiments, the *E. coli* causes a bacterial infection, such as mastitis. In some embodiments, the *E. coli* is a persistent *E. coli* strain. In some embodiments, the *E. coli* is a transient *E. coli* strain. In some embodiments, the composition further comprises a bacteriophage targeting a BIM of the *E. coli*, wherein the BIM is not targeted by the T4-like bacteriophage, the Schizo-T4-like bacteriophage, or the two rV5-related and phi92-related bacteriophages. In some embodiments, the bacteriophage targeting the BIM is p0045. In some embodiments, the delivery vehicle is suitable for intramammary administration. In some embodiments, the delivery vehicle is an ointment, such as a teat sealant. In some embodiments, the delivery vehicle is suitable for oral administration. In some embodiments, the delivery vehicle is suitable for parenteral administration. In some embodiments, the delivery vehicle is not water.

In some embodiments, there is provided a composition comprising at least four bacteriophages targeting *E. coli*, wherein the at least four bacteriophages comprise a first bacteriophage comprising a genome sequence having at least about 95% (such as at least about any one of 96%, 97%, 98%, 99%, 99.5%, 99.9% or more, or 100%) sequence identity to the genome sequence of p0031, a second bacteriophage comprising a genome sequence having at least about 95% (such as at least about any one of 96%, 97%, 98%, 99%, 99.5%, 99.9% or more, or 100%) sequence identity to the genome sequence of p0032, a third bacteriophage comprising a genome sequence having at least about 95% (such as at least about any one of 96%, 97%, 98%, 99%, 99.5%, 99.9% or more, or 100%) sequence identity to the genome sequence of p0033, and a fourth bacteriophage comprising a genome sequence having at least about 95% (such as at least about any one of 96%, 97%, 98%, 99%, 99.5%, 99.9% or more, or 100%) sequence identity to the genome sequence of p0034. In some embodiments, the first bacteriophage comprises a genome sequence having at least about 95% (such as at least about any one of 96%, 97%, 98%, 99%, 99.5%, 99.9% or more, or 100%) sequence identity to SEQ ID NO: 1. In some embodiments, the second bacteriophage comprises a genome sequence having at least about 95% (such as at least about any one of 96%, 97%, 98%, 99%, 99.5%, 99.9% or more, or 100%) sequence identity to SEQ ID NO:2. In some embodiments, the third bacteriophage comprises a genome sequence having at least about 95% (such as at least about any one of 96%, 97%, 98%, 99%, 99.5%, 99.9% or more, or 100%) sequence identity to SEQ ID NO: 3. In some embodiments, the fourth bacteriophage comprises a genome sequence having at least about 95% (such as at least about any one of 96%, 97%, 98%, 99%, 99.5%, 99.9% or more, or 100%) sequence identity to SEQ ID NO:4. In some embodiments, there is provided a composition comprising p0031, p0032, p0033, p0034 and a delivery vehicle. In some embodiments, the *E. coli* is a clinical isolate of *E. coli*. In some embodiments, the *E. coli* causes a bacterial infection, such as mastitis. In some embodiments, the *E. coli* is a persistent *E. coli* strain. In some embodiments, the *E. coli* is a transient *E. coli* strain. In some embodiments, the composition further comprises a bacteriophage targeting a BIM of the *E. coli*, wherein the BIM is not targeted by the first bacteriophage, the second bacteriophage, the third bacteriophage, or the fourth bacteriophage. In some embodiments, the delivery vehicle is suitable for intramammary administration. In some embodiments, the delivery vehicle is an ointment, such as a teat sealant. In some embodiments, the delivery vehicle is suitable for oral administration. In some embodiments, the delivery vehicle is suitable for parenteral administration. In some embodiments, the delivery vehicle is not water.

In some embodiments, there is provided a composition comprising at least five bacteriophages targeting *E. coli*, wherein the at least four bacteriophages comprise a first bacteriophage comprising a genome sequence having at least about 95% (such as at least about any one of 96%, 97%, 98%, 99%, 99.5%, 99.9% or more, or 100%) sequence identity to the genome sequence of p0031, a second bacteriophage comprising a genome sequence having at least about 95% (such as at least about any one of 96%, 97%, 98%, 99%, 99.5%, 99.9% or more, or 100%) sequence identity to the genome sequence of p0032, a third bacteriophage comprising a genome sequence having at least about 95% (such as at least about any one of 96%, 97%, 98%, 99%, 99.5%, 99.9% or more, or 100%) sequence identity to the genome sequence of p0033, a fourth bacteriophage comprising a genome sequence having at least about 95% (such as at least about any one of 96%, 97%, 98%, 99%, 99.5%, 99.9% or more, or 100%) sequence identity to the genome sequence of p0034, and a fifth bacteriophage comprising a genome sequence having at least about 95% (such as at least about any one of 96%, 97%, 98%, 99%, 99.5%, 99.9% or more, or 100%) sequence identity to the genome sequence of p0045. In some embodiments, the first bacteriophage comprises a genome sequence having at least about 95% (such as at least about any one of 96%, 97%, 98%, 99%, 99.5%, 99.9% or more, or 100%) sequence identity to SEQ ID NO: 1. In some embodiments, the second bacteriophage comprises a genome sequence having at least about 95% (such as at least about any one of 96%, 97%, 98%, 99%, 99.5%, 99.9% or more, or 100%) sequence identity to SEQ ID NO:2. In some embodiments, the third bacteriophage comprises a genome sequence having at least about 95% (such as at least about any one of 96%, 97%, 98%, 99%, 99.5%, 99.9% or more, or 100%) sequence identity to SEQ ID NO: 3. In some embodiments, the fourth bacteriophage comprises a genome sequence having at least about 95% (such as at least about any one of 96%, 97%, 98%, 99%, 99.5%, 99.9% or more, or 100%) sequence identity to SEQ ID NO:4. In some embodiments, the fifth bacteriophage comprises a genome sequence having at least about 95% (such as at least about any one of 96%, 97%, 98%, 99%, 99.5%, 99.9% or more, or 100%) sequence identity to SEQ ID NO: 5. In some embodiments, there is provided a composition comprising p0031, p0032, p0033, p0034, p0045 and a delivery vehicle. In some embodiments, the delivery vehicle is suitable for intramammary administration. In some embodiments, the delivery vehicle is an ointment, such as a teat sealant. In some embodiments, the delivery vehicle is suitable for oral administration. In some embodiments, the delivery vehicle is suitable for parenteral administration. In some embodiments, the delivery vehicle is not water.

In some embodiments, the composition comprises an additional bacteriophage targeting a Gram-negative bacterium. In some embodiments, the Gram-negative bacterium is selected from the group consisting of *Escherichia coli*, *Enterobacter* spp., *Citrobacter* spp., and *Klebsiella* spp., *Hafnia* spp., *Corynebacterium pyogenes*, *Mycoplasma bovis*, *Serratia* spp., *Pasteurella* spp., *Proteus* spp., *Campylobacter* ssp., *Salmonella* ssp., *Pseudomonas aeruginosa*, and *Brucella melitensis*. In some embodiments, the Gram-negative bacterium is a naturally occurring bacterium. In some embodiments, the Gram-negative bacterium is a clinical isolate of a bacterium that causes an infection, such as mastitis. In some embodiments, the Gram-negative bacterium is a coliform bacterium. In some embodiments, the Gram-negative bacterium is a mutant strain derived from a naturally occurring Gram-negative bacterium isolate. In some embodiments, the Gram-negative bacterium is a bacteriophage insensitive mutant (BIM). In some embodiments, the additional bacteriophage targets more than one (such as at least about any one of 2, 3, 4, 5, 10, 20, 30, 50, or more) clinical isolates of the bacterium, including clinical isolates from different geographical locations. In some embodiments, the composition comprises more than one (such as at least about any one of 2, 3, 4, 5, 10 or more) additional bacteriophages targeting a Gram-negative bacterium. In some embodiments, the composition comprises more than one (such as at least about any one of 2, 3, 4, 5, 10 or more) additional bacteriophages targeting more than one (such as at least about any one of 2, 3, 4, 5, 10 or more) Gram-negative bacteria.

Thus, in some embodiments, there is provided a composition comprising: (1) one or more (such as any one of 1, 2, 3, 4, or 5) bacteriophages comprising genome sequences having at least about 95% (such as at least about any one of 96%, 97%, 98%, 99%, 99.9%, or more, or 100%) sequence identity to the genome sequences of one or more (such as any one of 1, 2, 3, 4, or 5) bacteriophages selected from the group consisting of p0031, p0032, p0033, p0034, and p0045; (2) one or more (such as at least about any one of 1, 2, 3, 4, 5, 10 or more) additional bacteriophages targeting one or more (such as at least about any one of 1, 2, 3, 4, 5, 10 or more) Gram-negative bacteria; and (3) a delivery vehicle. In some embodiments, the Gram-negative bacteria are selected from the group consisting of *Escherichia coli*, *Enterobacter* spp., *Citrobacter* spp., and *Klebsiella* spp., *Hafnia* spp., *Corynebacterium pyogenes*, *Mycoplasma bovis*, *Serratia* spp., *Pasteurella* spp., *Proteus* spp., *Campylobacter* ssp., *Salmonella* ssp., *Pseudomonas aeruginosa*, and *Brucella melitensis*. In some embodiments, the composition comprises one or more (such as any one of 1, 2, 3, 4, or 5) bacteriophages comprising genome sequences having at least about 95% (such as at least about any one of 96%, 97%, 98%, 99%, 99.9%, or more, or 100%) sequence identity to SEQ ID NOs: 1-5. In some embodiments, the composition comprises one or more (such as any one of 1, 2, 3, 4, or 5) bacteriophages selected from the group consisting of p0031, p0032, p0033, p0034, and p0045. In some embodiments, the composition comprises p0031, p0032, p0033 and p0034. In some embodiments, the composition comprises p0031, p0032, p0033, p0034, and p0045. In some embodiments, the delivery vehicle is suitable for intramammary administration. In some embodiments, the delivery vehicle is an ointment, such as a teat sealant. In some embodiments, the delivery vehicle is suitable for oral administration. In some embodiments, the delivery vehicle is suitable for parenteral administration. In some embodiments, the delivery vehicle is not water.

In some embodiments, the composition comprises an additional bacteriophage targeting a Gram-positive bacterium. In some embodiments, the Gram-positive bacterium is selected from the group consisting of *Staphylococcus aureus, Streptococcus agalactiae, Streptococcus uberis, Streptococcus dysgalactiae, Streptococcus equinus, Staphylococcus hyicus, Staphylococcus simulans, Staphylococcus epidermidis, Staphylococcus chromogenes, Staphylococcus xylosus*, coagulase negative Stapholococci (CNS), *Corynebacterium bovis, Pasteurella* spp., *Trueperella pyogenes, Clostridium perfingens, Clostridium difficile*, and *Listeria* ssp. In some embodiments, the composition comprises a bacteriophage targeting *Staphylococcus aureus*. In some embodiments, the composition comprises a bacteriophage comprising a genome sequence having at least about 95% (such as at least about any one of 96%, 97%, 98%, 99%, 99.9% or more, or 100%) sequence identity to the genome sequence of p0014. In some embodiments, the composition comprises p0014. In some embodiments, the Gram-positive bacterium is a naturally occurring bacterium. In some embodiments, the Gram-positive bacterium is a clinical isolate of a bacterium that causes an infection, such as mastitis. In some embodiments, the Gram-positive bacterium is a mutant strain derived from a naturally occurring Gram-positive bacterium isolate. In some embodiments, the Gram-positive bacterium is a bacteriophage insensitive mutant (BIM). In some embodiments, the additional bacteriophage targeting the Gram-positive bacterium targets more than one (such as at least about any one of 2, 3, 4, 5, 10, 20, 30, 50, or more) clinical isolates of the bacterium, including clinical isolates from different geographical locations. In some embodiments, the composition comprises more than one (such as at least about any one of 2, 3, 4, 5, 10 or more) bacteriophages targeting a Gram-positive bacterium. In some embodiments, the composition comprises more than one (such as at least about any one of 2, 3, 4, 5, 10 or more) bacteriophages targeting more than one (such as at least about any one of 2, 3, 4, 5, 10 or more) Gram-positive bacteria.

Thus, in some embodiments, there is provided a composition comprising: (1) one or more (such as any one of 1, 2, 3, 4, or 5) bacteriophages comprising genome sequences having at least about 95% (such as at least about any one of 96%, 97%, 98%, 99%, 99.9%, or more, or 100%) sequence identity to the genome sequences of one or more (such as any one of 1, 2, 3, 4, or 5) bacteriophages selected from the group consisting of p0031, p0032, p0033, p0034, and p0045; (2) one or more (such as at least about any one of 1, 2, 3, 4, 5, 10 or more) additional bacteriophages targeting one or more (such as at least about any one of 1, 2, 3, 4, 5, 10 or more) Gram-positive bacteria; and (3) a delivery vehicle. In some embodiments, the Gram-positive bacterium is selected from the group consisting of *Staphylococcus aureus, Streptococcus agalactiae, Streptococcus uberis, Streptococcus dysgalactiae, Streptococcus equinus, Staphylococcus hyicus, Staphylococcus simulans, Staphylococcus epidermidis, Staphylococcus chromogenes, Staphylococcus xylosus*, coagulase negative Stapholococci (CNS), *Corynebacterium bovis, Pasteurella* spp., *Trueperella pyogenes, Clostridium perfingens, Clostridium difficile*, and *Listeria* ssp. In some embodiments, the composition comprises one or more (such as any one of 1, 2, 3, 4, or 5) bacteriophages comprising genome sequences having at least about 95% (such as at least about any one of 96%, 97%, 98%, 99%, 99.9%, or more, or 100%) sequence identity to SEQ ID NOs: 1-5. In some embodiments, the composition comprises one or more (such as any one of 1, 2, 3, 4, or 5) bacteriophages selected from the group consisting of p0031, p0032, p0033, p0034, and p0045. In some embodiments, the composition comprises p0031, p0032, p0033 and p0034. In some embodiments, the composition comprises p0031, p0032, p0033, p0034, and p0045. In some embodiments, the delivery vehicle is suitable for intramammary administration. In some embodiments, the delivery vehicle is an ointment, such as a teat sealant. In some embodiments, the delivery vehicle is suitable for oral administration. In some embodiments, the delivery vehicle is suitable for parenteral administration. In some embodiments, the delivery vehicle is not water.

In some embodiments, there is provided a composition comprising: (1) one or more (such as any one of 1, 2, 3, 4, or 5) bacteriophages comprising genome sequences having at least about 95% (such as at least about any one of 96%, 97%, 98%, 99%, 99.9%, or more, or 100%) sequence identity to the genome sequences of one or more (such as any one of 1, 2, 3, 4, or 5) bacteriophages selected from the group consisting of p0031, p0032, p0033, p0034, and p0045; (2) one or more (such as at least about any one of 1, 2, 3, 4, 5, 10 or more) additional bacteriophages targeting one or more (such as at least about any one of 1, 2, 3, 4, 5, 10 or more) Gram-negative bacteria; (3) one or more (such as at least about any one of 1, 2, 3, 4, 5, 10 or more) additional bacteriophages targeting one or more (such as at least about any one of 1, 2, 3, 4, 5, 10 or more) Gram-positive bacteria; and (4) a delivery vehicle. In some embodiments, the Gram-negative bacteria are selected from the group consisting of *Escherichia coli, Enterobacter* spp., *Citrobacter* spp., and *Klebsiella* spp., *Hafnia* spp., *Corynebacterium pyogenes, Mycoplasma bovis, Serratia* spp., *Pasteurella* spp., *Proteus* spp., *Campylobacter* ssp., *Salmonella* ssp., *Pseudomonas aeruginosa*, and *Brucella melitensis*. In some embodiments, the Gram-positive bacterium is selected from the group consisting of *Staphylococcus aureus, Streptococcus agalactiae, Streptococcus uberis, Streptococcus dysgalactiae, Streptococcus equinus, Staphylococcus hyicus, Staphylococcus simulans, Staphylococcus epidermidis, Staphylococcus chromogenes, Staphylococcus xylosus*, coagulase negative Stapholococci (CNS), *Corynebacterium bovis, Pasteurella* spp., *Trueperella pyogenes, Clostridium perfingens, Clostridium difficile*, and *Listeria* ssp. In some embodiments, the composition comprises one or more (such as any one of 1, 2, 3, 4, or 5) bacteriophages comprising genome sequences having at least about 95% (such as at least about any one of 96%, 97%, 98%, 99%, 99.9%, or more, or 100%) sequence identity to SEQ ID NOs: 1-5. In some embodiments, the composition comprises one or more (such as any one of 1, 2, 3, 4, or 5) bacteriophages selected from the group consisting of p0031, p0032, p0033, p0034, and p0045. In some embodiments, the composition comprises p0031, p0032, p0033 and p0034. In some embodiments, the composition comprises p0031, p0032, p0033, p0034, and p0045. In some embodiments, the delivery vehicle is suitable for intramammary administration. In some embodiments, the delivery vehicle is an ointment, such as a teat sealant. In some embodiments, the delivery vehicle is suitable for oral administration. In some embodiments, the delivery vehicle is suitable for parenteral administration. In some embodiments, the delivery vehicle is not water.

The additional bacteriophage targeting the Gram-negative bacterium or the Gram-positive bacterium may be selected from known bacteriophages, or isolated from an environmental sample, such as a sewage sample, using phage isolation methods known in the art. See, for example, Carlson K. "Working with bacteriophages: common techniques and methodological approaches. In Working with bacteriophages: common techniques and methodological approaches. CRC Press." 437-494 (2005); Clokie, M. R. J., and A. Kropinski. "Bacteriophages—Methods and Protocols, Volume 2: Molecular and Applied Aspects," 2. Humana Press. 19-20 (2009). In some embodiments, the additional bacteriophage is lytic. In some embodiments, the additional bacteriophage is lysogenic. In some embodiments, the Gram-negative or Gram-positive bacterium is a BIM that cannot be targeted by the other bacteriophages in the composition.

In some embodiments, there is provided a composition having a delivery vehicle, and a bacteriophage cocktail, wherein the delivery vehicle is selected from a bismuth-free and a bismuth-containing vehicle. In some embodiments, the bacteriophage cocktail is a combination of at least two different, isolated bacteriophages and can be used in the prevention or controlling of infection of an animal. In some embodiments, the infection is a bacterial infection and the at least two bacteriophage are lytic phages. In some embodiments, the bacteriophage cocktail is a combination of at least two different, isolated bacteriophages and can be used in the prevention or controlling of colonization of an animal. In some embodiments, the colonization is a bacterial colonization and the at least two bacteriophage are lytic phages. In some embodiments, the composition has a therapeutically effective amount of a bacteriophage cocktail, wherein the cocktail comprises at least two different isolated bacteriophages, and the bacteriophage cocktail is combined with a vehicle carrier and the therapeutically effective amount sufficient to treat a bacterial infection or a bacterial colonization. In some embodiments, the bacteriophage is lytic to a Gram-negative bacterium. In some embodiments, the bacteriophage is lytic to a Gram-positive bacterium. In some embodiments, the bacteria can cause a bacterial infection selected from the group consisting of mastitis, metritis, otitis, dermatitis, cystitis, infections of the eye including endophthalmitis and conjunctivitis, sinusitis and infections of the oral cavity. In some embodiments, the bacterial infection can be caused by one or more strains of *Escherichia coli, Pseudomonas aeruginosa, Corynebacterium pyogenes, Mycoplasma bovis, Serratia* ssp., *Klebsiella* ssp., *Campylobacter* ssp., *Salmonella* ssp., or *Enterobacter* ssp. In some embodiments, the bacterial infection can be caused by one or more strains of *Staphylococcus aureus, Streptococcus agalactiae, Streptococcus uberis, Streptococcus dysgalactiae, Streptococcus equinus, Staphylococcus hyicus, Staphylococcus simulans, Staphylococcus epidermidis, Staphylococcus chromogenes, Staphylococcus xylosus*, coagulase negative Stapholococci, or *Listeria* spp.

Any of the compositions described herein can also be provided without the delivery vehicle. In some embodiments, there is provided a composition comprising one or more (such as at least 2, 3, 4, or 5) bacteriophages, wherein the one or more bacteriophages target *Escherichia coli*, and wherein the one or more bacteriophages comprise genome sequences having at least about 95% (such as at least about any one of 96%, 97%, 98%, 99%, 99.5%, 99.9% or more, or 100%) sequence identity to the genome sequences of one or more bacteriophages selected from the group consisting of p0031, p0032, p0033, p0034, and p0045. In some embodiments, the one or more bacteriophages comprise genome sequences having at least about 95% (such as at least about any one of 96%, 97%, 98%, 99%, 99.5%, 99.9% or more, or 100%) sequence identity to one or more sequences selected from the group consisting of SEQ ID NOs: 1-5. In some embodiments, the one or more bacteriophages are selected from the group consisting of p0031, p0032, p0033, p0034, and p0045. In some embodiments, the composition comprises p0031, p0032, p0033, and p0034. In some embodiments, the composition comprises p0031, p0032, p0033, p0034, and p0045. In some embodiments, the composition further comprises one or more bacteriophages targeting one or more Gram-negative bacteria. In some embodiments, the Gram-negative bacteria are selected from the group consisting of *Escherichia coli, Enterobacter* spp., *Citrobacter* spp., and *Klebsiella* spp., *Hafnia* spp., *Corynebacterium pyogenes, Mycoplasma bovis, Serratia* spp., *Pasteurella* spp., *Proteus* spp., *Campylobacter* ssp., *Salmonella* ssp., *Pseudomonas aeruginosa*, and *Brucella melitensis*. In some embodiments, the composition further comprises one or more additional bacteriophages targeting one or more Gram-positive bacteria. In some embodiments, the Gram-positive bacteria are selected from the group consisting of *Staphylococcus aureus, Streptococcus agalactiae, Streptococcus uberis, Streptococcus dysgalactiae, Streptococcus equinus, Staphylococcus hyicus, Staphylococcus simulans, Staphylococcus epidermidis, Staphylococcus chromogenes, Staphylococcus xylosus*, coagulase negative Stapholococci (CNS), *Corynebacterium bovis, Pasteurella* spp., *Trueperella pyogenes, Clostridium perfingens, Clostridium difficile*, and *Listeria* ssp.

In some embodiments, the composition further comprises a de-agglomeration agent, such as a protease. In some embodiments, the composition further comprises an adjuvant composition for the de-agglomeration agent, such as a chelating agent and a reducing agent. "De-agglomeration agents" refer to agents that can reduce agglomeration of bacteria cells. De-agglomeration agents and adjuvant compositions useful for reducing agglomeration of bacteria cells have been described in International patent application No. PCT/US2016/028703 (Publication No. WO2016172380A1), which is incorporated herein by reference in its entirety.

Bacteriophages

The compositions described herein may comprise any number of bacteriophages, such as about any of 1, 2, 3, 4, 5, 6, 7, 8, 9, 10, or more. In some embodiments, the composition comprises a single bacteriophage. In some embodiments, the composition comprises a plurality of different, isolated bacteriophages. In some embodiments, the composition comprises at least about any one of 2, 3, 4, 5, 6, 10, 15, 20, or more bacteriophages. The isolation and characterization of exemplary bacteriophages including p0014, p0031, p0032, p0033, p0034, and p0045 are described in the examples, which can be used alone and in combination as bacteriophage cocktails in the prevention, treatment, control and reversal of a bacterial infection or a bacterial colonization within an animal. Bacterial strain specificity, morphology, family and subfamily can be used to differentiate the plurality of bacteriophages. The bacteriophages can also be differentiated based on their genome sequence, which can be obtained using any known sequencing methods and genome assembly methods in the art. Families and subfamilies of the bacteriophages may be assigned based on sequence homology or identity of the genome of the bacteriophages to known bacteriophages, for example, using NCBI's BLAST program.

Each bacteriophage in the composition is present at a suitable concentration. In some embodiments, the bacteriophage(s) in the composition is at least about any one of 5%, 10%, 20%, 30%, 40%, 50%, 60%, 70%, 80%, 90%, or more of the composition by weight. In some embodiments, the composition comprises at least about any one of $10^4$, $10^5$, $10^6$, $10^7$, $10^8$, $10^9$, $10^{10}$, $10^{11}$, or $10^{12}$ PFU/mL of each bacteriophage. The concentration of bacteriophage may be determined using known phage titration protocols. In some embodiments, the composition comprises an effective amount of the bacteriophage or bacteriophage cocktail. The concentration of bacteriophage may be determined using known phage titration protocols. The concentration of bacteriophage varies depending upon the carrier and method of administration. In some embodiments, the bacteriophage concentration in the composition is at least about any one of $10^5$, $10^6$, $10^7$, $10^8$, $10^9$, $10^{10}$, or $10^{11}$ Plaque Forming Units (PFU)/milliliter (ml). The concentration of bacteriophage varies depending upon the delivery vehicle and methods of administration.

The relative ratio by Plaque Forming Units (PFU) between different bacteriophages in the composition may be chosen to optimize the efficacy of the composition or to enhance synergy among the different bacteriophages. In some embodiments, each bacteriophage is present at about equal PFU in the composition. In some embodiments, one bacteriophage is present at about any one of 1.5, 2, 3, 4, 5, 10 or more PFU than another bacteriophage in the composition. In some embodiments, wherein a composition comprising four bacteriophages (such as p0031, p0032, p0033, and p0034), the relative ratio (by PFU) among the four bacteriophages is about 1:1:1:1. In some embodiments, wherein a composition comprising five bacteriophages (such as p0031, p0032, p0033, p0034, and p0045), the relative ratio (by PFU) among the five bacteriophages is about 1:1:1:1:1.

In some embodiments, the composition comprises one or more bacteriophages targeting *E. coli*, such as clinical isolates of *E. coli*. *Escherichia coli* is an opportunistic environmental pathogen and strains isolated from cows with mastitis are genetically diverse, even from the same farm (Moser et al., Schweiz. Arch. Für Tierheilkd. (2013) 155: 351-357). Some literature reports that no specific genetic markers or virulence factors have been identified which can distinguish mastitis strains from environmental *E. coli* isolated from dairies (Wenz et al., J. Dairy Sci. (2006) 89:3408-3412). Bacteriophages that are isolated using a single clinical strain may not be able to infect different field strains due to high bacterial host specificity.

In some embodiments, the composition comprises one or more bacteriophages targeting one or more persistent *E. coli* strains. Certain *E. coli* strains are able to persist in cows via intracellular invasion of mammary epithelial cells while avoiding endosome-lysosome fusion and endosome acidification. See, for example, Almeida, et al., Vet. Res. Commun. (2011) 35:89-101; Almeida et al., J. Dairy Sci. (1996) 79:1021-1026; Passey et al., Vet. Microbiol. (2008) 130: 151-164. As used herein, a "persistent *E. coli* strain" is able to invade a cell, e.g., an epithelial cell, and avoid an immune response, thus establishing a clinically chronic mastitis infection, or it can persist due to antimicrobial resistance, or due to increased swimming and swarming ability. *E. coli* strains P4, P5 and P6 described in Examples 1-6 and 8. In some embodiments, the composition comprises one or more bacteriophages targeting one or more transient *E. coli* strains. As used herein, "transient *E. coli* strain" causes infection for only a short period, e.g. 2-3 days. By using cultured bovine mammary epithelial cells, we have attempted to analyze our phage cocktail's ability to prevent chronic coliform mastitis under conditions that approximate the teat canal and mammary gland environment. Pre-application of bacteriophage significantly reduces *E. coli*'s ability to adhere and invade bovine mammary epithelial cells, suggesting that by carefully selecting and isolating bacteriophages having broad host-range specificities, a bacteriophage cocktail can be used to prevent cases of *E. coli* mastitis.

In some embodiments, the composition comprises one or more bacteriophages targeting BIMs, such as BIMs of a clinical isolate of *E. coli*. BIMs can be isolated from a co-culture of one or more bacteriophages and the targeted bacterium or bacteria thereof, in which the Multiplicity of Infection (MOI) of the one or more bacteriophages with respect to the targeted bacterium or bacteria is no more than about any of 100, 50, 20, 10, 5, 4, 3, 2, 1, 0.5, 0.1 or less. In some embodiments, the BIMs are isolated after co-culture of the bacteriophages and the targeted bacterium or bacteria over a period of at least 12, 24, 36, 48, 72 or more hours. In some embodiments, the BIM is sequenced to confirm that the BIM belongs to the same species as the targeted bacterium. Exemplary BIMS of a clinical isolate of *E. coli*, b00ca, are described in Example 8, including r0037, r003h and r003j.

The bacteriophages described herein can be lytic or lysogenic. A lytic phage has the ability to lyse out of the bacterial host cell following phage replication, and the phage progeny is able to infect new bacterial host cells. A lysogenic phage, in contrast, integrates its viral genome with the host DNA, replicating along with the host's DNA and can be relatively non-detrimental, possibly establishing itself as a plasmid. However, the dormancy of the lysogenic phage can end if host nutrients become depleted or other conditions for growth become unfavorable. The lysogenic phage then undergoes replication resulting in lysis of the host cell releasing phage. However, because the lysogenic cycle does not destroy the host cell, the host continues to replicate its and the viral genome in each of the host cell's offspring.

In some embodiments, the composition comprises one or more bacteriophages targeting bacteria that cause a bacterial infection (also referred herein as "causative bacteria"). In some embodiments, the bacterial infection is selected from the group consisting of mastitis, metritis, otitis, dermatitis, cystitis, infections of the eye including endophthalmitis and conjunctivitis, sinusitis and infections of the oral cavity. In some embodiments, the composition comprises one or more bacteriophages targeting coliform bacteria. As used herein the term "coliform" can refer to Gram (−), rod-shaped bacteria able to ferment lactose and in doing so produce acid and gas when incubated at 35-37° C. A bacterium can be classified as a coliform bacterium using known microbiological methods in the art. Examples of genera classified as coliform bacteria include, but are not limited to, *Citrobacter, Enterobacter, Escherichia, Kelebsiella,* and *Hafnia*.

As is known to one of skill in the art, causative bacteria of mastitis, metritis, otitis, dermatitis, cystitis, infections of the eye including endophthalmitis and conjunctivitis, sinusitis and infections of the oral cavity can be, Gram-negative bacteria, including but not limited to i.e., coliform bacteria, including but not limited to one or more strains of *Escherichia coli, Enterobacter* spp., *Citrobacter* spp., and *Klebsiella* spp., *Pseudomonas aeruginosa, Corynebacterium pyogenes, Mycoplasma bovis, Serratia* spp., *Pasteurella* spp., *Proteus* spp., *Pseudomonas aeruginosa,* and *Brucella*

*melitensis*. The *Candida* spp. yeast and the alga Prototheca zopfil and *Prototheca wickerhamii* are also implicated in mastitis. Gram-positive bacteria that are also causative agents of mastitis, metritis, otitis, dermatitis, cystitis, infections of the eye including endophthalmitis and conjunctivitis, sinusitis and infections of the oral cavity including but not limited to one or more strains of *Staphylococcus aureus, Streptococcus agalactiae, Streptococcus uberis, Streptococcus dysgalactiae, Streptococcus* equinus, *Staphylococcus hyicus, Staphylococcus simulans, Staphylococcus epidermidis, Staphylococcus chromogenes, Staphylococcus xylosus*, coagulase negative Stapholococci (CNS), *Corynebacterium bovis, Pasteurella* spp. *Trueperella pyogenes, Clostridium perfingens, Clostridium difficile*, and *Listeria* ssp.

The bacteriophages or bacteriophage cocktail described herein can be formulated in pharmaceutical compositions comprising the bacteriophage and a pharmaceutically acceptable carrier. Alternatively, the bacteriophage or bacteriophage cocktails can be stored as a concentrated aqueous solution or lyophilized powder preparation.

Delivery Vehicle

The compositions described herein comprise a delivery vehicle that is designed to facilitate application or administration of the compositions. In some embodiments, the delivery vehicle further stabilizes the bacteriophage(s), and/or enhances the efficacy of the bacteriophage(s) on inhibiting bacterial infection. The delivery vehicle is chosen according to the use of the bacteriophage compositions as described in further detail below. In some embodiments, the delivery vehicle is a liquid vehicle suitable for administration by infusion or injection. In some embodiments, the delivery vehicle is a buffer, such as phosphate buffered saline (PBS), Luria-Bertani Broth, phage buffer (100 mM NaCl, 100 mM Tris-HCl, 0.01% (w/v) Gelatin), or Tryptic Soy broth (TSB). In some embodiments, the delivery vehicle is a solid vehicle suitable for administration by inhalation or for application by spraying. In some embodiments, the delivery vehicle is a semi-solid or semi-liquid vehicle, such as a gel, cream, paraffin wax, or ointment, suitable for topical application. In some embodiments, the delivery vehicle further comprises food grade oil(s), and inorganic salts useful for adjusting the viscosity of the bacteriophage composition and for detection of the bacteriophage composition once applied or administered.

In some embodiments, the composition is a pharmaceutical composition, wherein the delivery vehicle is a pharmaceutically acceptable carrier. Pharmaceutically acceptable carriers are well known, and one skilled in the pharmaceutical art can easily select carriers suitable for particular routes of administration (Remington's Pharmaceutical Sciences, Mack Publishing Co., Easton, Pa., 1985). Suitable pharmaceutical carriers include, but are not limited to, sterile water; saline, dextrose; dextrose in water or saline; condensation products of castor oil and ethylene oxide combining about 30 to about 35 moles of ethylene oxide per mole of castor oil; liquid acid; lower alkanols; oils such as corn oil; peanut oil, sesame oil and the like, with emulsifiers such as mono- or di-glyceride of a fatty acid, or a phosphatide, e.g., lecithin, and the like; glycols; polyalkylene glycols; aqueous media in the presence of a suspending agent, for example, sodium carboxymethylcellulose; sodium alginate; poly(vinylpyrolidone); and the like, alone, or with suitable dispensing agents such as lecithin; polyoxyethylene stearate; and the like. The carrier may also contain adjuvants such as preserving stabilizing, wetting, emulsifying agents and the like together with the penetration enhancer. The final form may be sterile and may also be able to pass readily through an injection device such as a hollow needle. The proper viscosity may be achieved and maintained by the proper choice of solvents or excipients. Moreover, the use of molecular or particulate coatings such as lecithin, the proper selection of particle size in dispersions, or the use of materials with surfactant properties may be utilized. In some embodiments, the composition is in a form suitable for introduction by a syringe.

In some embodiments, the delivery vehicle comprises other agents, excipients, or stabilizers to improve properties of the composition, which do not reduce the effectiveness of the bacteriophage or bacteriophage cocktails. Examples of suitable excipients and diluents include, but are not limited to, lactose, dextrose, sucrose, sorbitol, mannitol, starches, gum acacia, calcium phosphate, alginates, tragacanth, gelatin, calcium silicate, microcrystalline cellulose, polyvinylpyrrolidone, cellulose, water, saline solution, syrup, methylcellulose, methyl- and propylhydroxybenzoates, talc, magnesium stearate and mineral oil. The formulations can additionally include lubricating agents, wetting agents, emulsifying and suspending agents, preserving agents, sweetening agents or flavoring agents. Examples of emulsifying agents include tocopherol esters such as tocopheryl polyethylene glycol succinate and the like, PLURONIC®, emulsifiers based on polyoxy ethylene compounds, Span® 80 and related compounds and other emulsifiers known in the art and approved for use in animals or human dosage forms. The compositions (such as pharmaceutical compositions) can be formulated so as to provide rapid, sustained or delayed release of the active ingredient after administration to an individual by employing procedures well known in the art.

In some embodiments, the composition (such as pharmaceutical composition) is formulated to have a pH in the range of about 4.5 to about 9.0, including for example pH ranges of any one of about 5.0 to about 8.0, about 6.5 to about 7.5, or about 6.5 to about 7.0. In some embodiments, the pH of the composition (such as pharmaceutical composition) is formulated to no less than about 6, including for example no less than about any one of 6.5, 7, or 8 (e.g., about 8). The composition (such as pharmaceutical composition) can also be made to be isotonic with blood by the addition of a suitable tonicity modifier, such as glycerol.

In some embodiments, the composition comprises a delivery vehicle suitable for intramammary administration, such as administration within a teat canal. In some embodiments, the delivery vehicle is suitable for injection. In some embodiments, the delivery vehicle is suitable for infusion. In some embodiments, the delivery vehicle is suitable for topical application. In some embodiments, the delivery vehicle is an ointment. In some embodiments, the delivery vehicle is a medium used to seal a teat. In some embodiments, the medium comprises a heavy metal salt. In some embodiments, the delivery vehicle comprises bismuth. In some embodiments, the medium is free of metal salts. In some embodiments, the delivery vehicle is free of bismuth. In some embodiments, the delivery vehicle further comprises a paraffin wax, food-grade oil or other viscosity adjusting reagents known to one of skill in the art. In some embodiments, delivery vehicle is suitable for infusion, injection, or application to the mammary gland, including but not limited to the teat, the teat opening, into the teat streak canal, or teat sinus.

In some embodiments, the composition comprises a delivery vehicle suitable for oral administration. In some embodiments, the delivery vehicle is an aqueous medium, such as deionized water, mineral water, 5% sucrose solution, glycerol, dextran, polyethylene glycol, sorbitol, or such other formulations that maintain phage viability, and are non-toxic to animals, including lactating mammals and humans. In some embodiments, the composition is prepared by resuspending purified phage preparation in the aqueous medium.

In some embodiments, the composition comprises a delivery vehicle suitable for parenteral administration, such as intravenous administration or subcutaneous administration. In some embodiments, the delivery vehicle is suitable for infusion. In some embodiments, the delivery vehicle is suitable for injection. Formulations suitable for parenteral administration include aqueous and non-aqueous, isotonic sterile injection solutions, which can contain anti-oxidants, buffers, bacteriostats, and solutes that render the formulation compatible with the blood of the intended recipient, and aqueous and non-aqueous sterile suspensions that can include suspending agents, solubilizers, thickening agents, stabilizing agents, and preservatives.

In some embodiments, the delivery vehicle comprises the delivery vehicle, carrier, or formulation of any one of the mastitis products listed in Table 1 below. The compositions can be prepared by replacing the antibiotic or other active ingredient in the mastitis products with a bacteriophage or bacteriophage cocktail described herein.

TABLE 1

| Product | Active Antibiotic | Manufacturer |
| --- | --- | --- |
| SPECTRAMAST® (Lactating Cow and Dry Cow) | Ceftiofur | Zoetis |
| PIRSUE® | pirlimycin | Zoetis |
| ALBADRY® Plus (dry cow) | PenG procaine and novobiocin | Zoetis |
| QUARTERMASTER® (dry cow) | Penicillin dihydrostreptomycin | WG Critical Care |
| TODAY®/ TOMORROW® | Cephapirin | Boehringer Ingelheim Vetmedica (formerly Cefa-Lak and Cefa-Dri when produced by Fort Dodge) |
| HETACIN K® | Hetacillin (ampicillin) | Boehringer Ingelheim Vetmedica |
| DRY-CLOX® | Cloxacillin | Boehringer Ingelheim Vetmedica |
| GO-DRY® (dry cow) | Pen G Procaine | G C Hanford |
| MASTI-CLEAR® (lactating cow) | Pen G Procaine | G C Hanford |
| AMOXI-MAST® | amoxicillin | Merck (currently labeled Schering-Plough) |
| DARICLOX® | cloxacillin | Merck (currently labeled says Schering-Plough) |
| ORBENIN®-DC (dry cow) | Cloxacillin | Merck (currently labeled Schering-Plough |

In some embodiments, the composition (such as pharmaceutical composition) is suitable for administration to an animal. In some embodiments, the composition is suitable for administration to an animal capable of lactating. In some embodiments, the composition is suitable for administration to a teat canal of an animal, wherein the animal can be at a time period selected from the group consisting of the dry period, the lactating period and the beginning of the dry period at cessation of milking. In some embodiments, the animal is selected from the group consisting of a cow, a goat, a sheep, a buffalo, a camel, a donkey, a llama, a horse, a pig, a human, a primate, an avian, a fish, a mule, a cat and a dog. In some embodiments, the composition is suitable for administration to a dairy cow. In some embodiments, the composition comprises a delivery vehicle suitable for administration to a dry cow, such as the delivery vehicle from SPECTRAMAST®, ALBADRY® Plus, GO-DRY®, QUARTERMASTER® or ORBENIN®-DC. In some embodiments, the composition comprises a delivery vehicle suitable for administration to a lactating cow, such as the delivery vehicle from SPECTRAMAST®, or MASTI-CLEAR®.

The bacteriophages or bacteriophage cocktails can be formulated as a concentrate composition or a ready-to-use composition. A concentrate composition is often less expensive to ship and easier to store than a ready-to-use composition. The concentrate refers to the composition that is intended to be diluted to form the ready-to-use composition. The compositions can be presented in unit-dose or multi-dose sealed containers, such as ampules and vials, and can be stored in a freeze-dried (lyophilized) condition requiring only the addition of the sterile liquid excipient methods of treatment, methods of administration, and dosage regimens described herein for injection or infusion, immediately prior to use. Extemporaneous injection solutions and suspensions can be prepared from sterile powders, granules, and tablets of the kind previously described. Upon reconstitution, the phage titer can be verified using phage titration protocols and host bacteria. One of skill in the art would be capable of determining bacteriophage titers using widely known bacteriophage assay techniques (Davis et al., Microbiology, 3rd Ed., Harper & Row, Hagerstown, Md. (1980), pp. 874-877, 880-883).

In some embodiments, there is provided a composition comprising a delivery vehicle and a bacteriophage cocktail. The bacteriophage within the cocktail can be composed of bacteriophages that infect Gram (+), Gram (−) and a mixture of both Gram (−) and Gram (+) bacteria strains. The delivery vehicle can be a petroleum-based jelly product, an oil, an ointment, gel, cream, salve or unguent. Suitable vehicles include but are not limited to a petroleum jelly, paraffin and other waxes as is known to one of skill in the art, and an oil such as a food-grade oil, such as almond, canola, coconut, corn, flaxseed, grape-seed, hazelnut, mineral, olive, safflower, vegetable, and walnut oils. Additionally, the vehicle can have either a bismuth-free and or a bismuth-containing component. Other heavy metal salts, as are known to one of skill in the art, can also be present.

III. Methods of Use

The bacteriophage compositions described herein can be useful for treating of a wide range of microbial infections, including infections caused by Gram-positive bacteria, Gram-negative bacteria and viruses. The bacteriophage compositions described herein can also be useful for inhibition of bacterial adhesion, invasion, and/or colonization to epithelial cells, and for inhibition of bacterial growth both in vitro and in vivo.

Methods of Treating or Preventing Bacterial Infection

In some embodiments, there is provided a method of treating or preventing a disease caused by a bacterial infection in an individual comprising administering to the individual an effective amount of any one of the compositions described herein. In some embodiments, the disease is selected from the group consisting of mastitis, metritis, otitis, dermatitis, cystitis, endophthalmitis, conjunctivitis, sinusitis, and infections of oral cavity. In some embodiments, the composition is administered more than once (such as at least about any one of 2, 3, 4, 5, or more times).

In some embodiments, there is provided a method of treating or preventing a disease caused by a bacterial infection in an individual comprising administering to the individual an effective amount of a composition comprising one or more (such as at least 2, 3, 4, or 5) bacteriophages and a delivery vehicle, wherein the one or more bacteriophages target *Escherichia coli*, and wherein the one or more bacteriophages comprise genome sequences having at least about 95% (such as 100%) sequence identity to the genome sequences of one or more bacteriophages selected from the group consisting of p0031, p0032, p0033, p0034, and p0045. In some embodiments, the one or more bacteriophages comprise genome sequences having at least about 95% (such as 100%) sequence identity to one or more sequences selected from the group consisting of SEQ ID NOs: 1-5. In some embodiments, the one or more bacteriophages are selected from the group consisting of p0031, p0032, p0033, p0034, and p0045. In some embodiments, the composition comprises p0031, p0032, p0033, and p0034. In some embodiments, the composition comprises p0031, p0032, p0033, p0034, and p0045. In some embodiments, the composition further comprises one or more bacteriophages targeting one or more Gram-negative bacteria. In some embodiments, the Gram-negative bacteria are selected from the group consisting of *Escherichia coli, Enterobacter* spp., *Citrobacter* spp., and *Klebsiella* spp., *Hafnia* spp., *Corynebacterium pyogenes, Mycoplasma bovis, Serratia* spp., *Pasteurella* spp., *Proteus* spp., *Campylobacter* ssp., *Salmonella* ssp., *Pseudomonas aeruginosa*, and *Brucella melitensis*. In some embodiments, the composition further comprises one or more additional bacteriophages targeting one or more Gram-positive bacteria. In some embodiments, the Gram-positive bacteria are selected from the group consisting of *Staphylococcus aureus, Streptococcus agalactiae, Streptococcus uberis, Streptococcus dysgalactiae, Streptococcus equinus, Staphylococcus hyicus, Staphylococcus simulans, Staphylococcus epidermidis, Staphylococcus chromogenes, Staphylococcus xylosus*, coagulase negative Stapholococci (CNS), *Corynebacterium bovis, Pasteurella* spp., *Trueperella pyogenes, Clostridium perfingens, Clostridium difficile*, and *Listeria* ssp. In some embodiments, the disease is selected from the group consisting of mastitis, metritis, otitis, dermatitis, cystitis, endophthalmitis, conjunctivitis, sinusitis, and infections of oral cavity. In some embodiments, the composition is administered more than once (such as at least about any one of 2, 3, 4, 5, or more times).

In some embodiments, there is provided a method of treating or preventing mastitis in an individual comprising administering to the individual an effective amount of any one of the compositions described herein. In some embodiments, the mastitis is caused by a coliform bacterium. In some embodiments, the individual is a dairy cow. In some embodiments, the mastitis is subclinical mastitis. In some embodiments, the mastitis is chronic mastitis. In some embodiments, the mastitis is septic mastitis. In some embodiments, the composition is administered intramammarily. In some embodiments, the individual is subsequently administered a teat sealant. In some embodiments, the composition is administered during a lactating period. In some embodiments, the composition is administered during a dry period. In some embodiments, the composition is administered at the beginning of the dry period at cessation of milking. In some embodiments, the composition is administered during a transition period. In some embodiments, the composition is administered more than once (such as at least about any one of 2, 3, 4, 5, or more times).

In some embodiments, there is provided a method of treating or preventing mastitis in an individual comprising administering to the individual an effective amount of a composition comprising one or more (such as at least 2, 3, 4, or 5) bacteriophages and a delivery vehicle, wherein the one or more bacteriophages target *Escherichia coli*, and wherein the one or more bacteriophages comprise genome sequences having at least about 95% (such as 100%) sequence identity to the genome sequences of one or more bacteriophages selected from the group consisting of p0031, p0032, p0033, p0034, and p0045. In some embodiments, the one or more bacteriophages comprise genome sequences having at least about 95% (such as 100%) sequence identity to one or more sequences selected from the group consisting of SEQ ID NOs: 1-5. In some embodiments, the one or more bacteriophages are selected from the group consisting of p0031, p0032, p0033, p0034, and p0045. In some embodiments, the composition comprises p0031, p0032, p0033, and p0034. In some embodiments, the composition comprises p0031, p0032, p0033, p0034, and p0045. In some embodiments, the composition further comprises one or more bacteriophages targeting one or more Gram-negative bacteria. In some embodiments, the Gram-negative bacteria are selected from the group consisting of *Escherichia coli, Enterobacter* spp., *Citrobacter* spp., and *Klebsiella* spp., *Hafnia* spp., *Corynebacterium pyogenes, Mycoplasma bovis, Serratia* spp., *Pasteurella* spp., *Proteus* spp., *Campylobacter* ssp., *Salmonella* ssp., *Pseudomonas aeruginosa*, and *Brucella melitensis*. In some embodiments, the composition further comprises one or more additional bacteriophages targeting one or more Gram-positive bacteria. In some embodiments, the Gram-positive bacteria are selected from the group consisting of *Staphylococcus aureus, Streptococcus agalactiae, Streptococcus uberis, Streptococcus dysgalactiae, Streptococcus equinus, Staphylococcus hyicus, Staphylococcus simulans, Staphylococcus epidermidis, Staphylococcus chromogenes, Staphylococcus xylosus*, coagulase negative Stapholococci (CNS), *Corynebacterium bovis, Pasteurella* spp., *Trueperella pyogenes, Clostridium perfingens, Clostridium difficile*, and *Listeria* ssp. In some embodiments, the individual is a dairy cow. In some embodiments, the mastitis is subclinical mastitis. In some embodiments, the mastitis is chronic mastitis. In some embodiments, the mastitis is septic mastitis. In some embodiments, the composition is administered intramammarily. In some embodiments, the individual is subsequently administered a teat sealant. In some embodiments, the composition is administered during a lactating period. In some embodiments, the composition is administered during a dry period. In some embodiments, the composition is administered at the beginning of the dry period at cessation of milking. In some embodiments, the composition is administered during a transition period. In some embodiments, the composition is administered more than once (such as at least about any one of 2, 3, 4, 5, or more times).

In some embodiments, there is provided a method for reducing the number of bacterial cells that cause a disease (such as mastitis) in an individual comprising administering to the individual an effective amount of a composition comprising one or more (such as at least 2, 3, 4, or 5) bacteriophages and a delivery vehicle, wherein the one or more bacteriophages target *Escherichia coli*, and wherein the one or more bacteriophages comprise genome sequences having at least about 95% (such as 100%) sequence identity to the genome sequences of one or more bacteriophages selected from the group consisting of p0031, p0032, p0033, p0034, and p0045. In some embodiments, the one or more bacteriophages comprise genome sequences having at least about 95% (such as 100%) sequence identity to one or more sequences selected from the group consisting of SEQ ID NOs: 1-5. In some embodiments, the one or more bacteriophages are selected from the group consisting of p0031, p0032, p0033, p0034, and p0045. In some embodiments, the composition comprises p0031, p0032, p0033, and p0034. In some embodiments, the composition comprises p0031, p0032, p0033, p0034, and p0045. In some embodiments, the composition further comprises one or more bacteriophages targeting one or more Gram-negative bacteria. In some embodiments, the Gram-negative bacteria are selected from the group consisting of *Escherichia coli, Enterobacter* spp., *Citrobacter* spp., and *Klebsiella* spp., *Hafnia* spp., *Corynebacterium pyogenes, Mycoplasma bovis, Serratia* spp., *Pasteurella* spp., *Proteus* spp., *Campylobacter* ssp., *Salmonella* ssp., *Pseudomonas aeruginosa*, and *Brucella melitensis*. In some embodiments, the composition further comprises one or more additional bacteriophages targeting one or more Gram-positive bacteria. In some embodiments, the Gram-positive bacteria are selected from the group consisting of *Staphylococcus aureus, Streptococcus agalactiae, Streptococcus uberis, Streptococcus dysgalactiae, Streptococcus equinus, Staphylococcus hyicus, Staphylococcus simulans, Staphylococcus epidermidis, Staphylococcus chromogenes, Staphylococcus xylosus*, coagulase negative Stapholococci (CNS), *Corynebacterium bovis, Pasteurella* spp., *Trueperella pyogenes, Clostridium perfingens, Clostridium difficile*, and *Listeria* ssp. In some embodiments, the disease is selected from the group consisting of mastitis, metritis, otitis, dermatitis, cystitis, endophthalmitis, conjunctivitis, sinusitis, and infections of oral cavity. In some embodiments, the composition is administered more than once. In some embodiments, the number of bacterial cells is reduced by at least about any one of 90%, 95%, 99%, 99.9%, 99.99%, 99.999%, 99.9999% or more. In some embodiments, the disease is mastitis. In some embodiments, the individual is a dairy cow. In some embodiments, the mastitis is subclinical mastitis. In some embodiments, the mastitis is chronic mastitis. In some embodiments, the mastitis is septic mastitis. In some embodiments, the composition is administered intramammarily. In some embodiments, the individual is subsequently administered a teat sealant. In some embodiments, the composition is administered during a lactating period. In some embodiments, the composition is administered during a dry period. In some embodiments, the composition is administered at the beginning of the dry period at cessation of milking. In some embodiments, the composition is administered during a transition period. In some embodiments, the composition is administered more than once (such as at least about any one of 2, 3, 4, 5, or more times).

In some embodiments, there is provided a method for preventing, treating and reversing a bacterial infection, comprising administering to an animal a composition having a delivery vehicle, and a bacteriophage cocktail. In some embodiments, the method can be for preventing a bacterial infection in an animal comprising administering to the animal an effective amount of a composition having a delivery vehicle, and a bacteriophage cocktail. In some embodiments, the method can be for treating a bacterial infection in an animal comprising administering to the animal an effective amount of a composition having a delivery vehicle, and a bacteriophage cocktail. In some embodiments, the method can be for controlling a bacterial infection in an animal comprising administering to the animal an effective amount of a composition having a delivery vehicle, and a bacteriophage cocktail. In some embodiments, the bacteriophage of the methods can be lytic to a Gram-negative bacteria. In some embodiments, the bacteriophage of the methods can be lytic to a Gram-positive bacteria. In some embodiments, the bacteria causes bacterial infection selected from the group consisting mastitis, metritis, otitis, dermatitis, cystitis, infections of the eye including endophthalmitis and conjunctivitis, sinusitis and infections of the oral cavity. In some embodiments, the bacterial infection can be caused by one or more strains of *Escherichia coli, Pseudomonas aeruginosa, Corynebacterium pyogenes, Mycoplasma bovis, Serratia, Klebsiella, Campylobacter, Salmonella*, or *Enterobacter*. In some embodiments, the bacterial infection can be caused by one or more strains of *Staphylococcus aureus, Streptococcus agalactiae, Streptococcus uberis, Streptococcus dysgalactiae, Streptococcus equinus, Staphylococcus hyicus, Staphylococcus simulans, Staphylococcus epidermidis, Staphylococcus chromogenes, Staphylococcus xylosus*, coagulase negative Stapholococci, or *Listeria* spp. In some embodiments, the methods can be used for the treatment of a disease, wherein the disease is mastitis. In some embodiments, of the methods, the animal administered the disclosed composition is capable of lactating, wherein the animal can be at a time period selected from the group consisting of the dry period, the lactating period and the beginning of the dry period at cessation of milking. In some embodiments, the mastitis resides in a mammary gland. In some embodiments, the composition of the methods can be administered to at least one infected mammary gland of the animal. In some embodiments, the composition of the methods can be administered to a teat canal of the animal. In some embodiments, the composition of the methods can have continuous contact with epithelial cells of the mammary gland.

As used herein the terms "reverse," "reversal," and "reversing" are used interchangeably and can refer to the use of the present invention to treat an infected gland or tissue as to reverse the infection and heal e.g., the mammary gland, both in human and non-human mammals. As used herein the terms "control" and "controlling" can refer to the treatment and preventive or prophylactic methods or measures taken to avoid, cure, treat and/or prevent an agent infecting or colonizing of a tissue by its invading and multiplying within the host's tissues and the tissue's reaction to the agents and the toxins produced by the agents. Examples of infectious agents include but are not limited to bacteria, viruses, fungi, algae, arthropods and nematodes.

In order for phage therapy to be a viable alternative to antibiotics, a number of important obstacles need to be overcome (Tsonos et al, Vet. Microbiol. 171:460-469, 2014). *E. coli* bacteriophages often infect specific strains which limit their ability to infect a diverse group of disease-causing coliform isolates, thus use of multiple phages in a cocktail may be required to increase host range (Brüssow, H. 2005. Phage therapy: the *Escherichia coli* experience. Microbiology. 151:2133-2140). Phage cocktails are also used in an attempt to combat bacterial resistance that can develop due to evolutionary dynamics between bacteriophages and their hosts (Lu, T. K., and M. S. Koeris. 2011. The next generation of bacteriophage therapy. Curr. Opin. Microbiol. 14:524-531). Although it is easy to demonstrate bacteriophage activity in vitro, relatively few studies have addressed how phages infect bacteria, replicate and persist under in vivo conditions. For example, in order for phage to be effective in treating, controlling or preventing mastitis, it must be able to lyse bacteria in the presence of raw milk and dry cow secretions. In fact, previous work done with *Staphylococcus*

*aureus* and bacteriophage K showed that phage attachment and lytic activity was suppressed in raw whole milk but not in heat-treated milk or milk whey (O'Flaherty, et al. (2005) Lett. Appl. Microbiol. 41:274-279; Gill et al. (2006). *J. Appl. Microbiol.* 101 377-386 10, respectively).

Previous work has shown that bacteriophage can be co-internalized with bacteria into eukaryotic cells. See, for example, Hsia et al., Microbes Infect. (2000) 2:761-772; Capparelli, et al., Antimicrob. Agents Chemother. (2007) 51:2765-2773; Ray et al., Nat. Rev. Microbiol. (2009) 7:333-340. In the present application, unexpectedly, it was found that the disclosed bacteriophages remained viable within mammary epithelial cells in vitro even after three days, indicating that bacteriophages can be useful for clearing and controlling chronic mastitis cases that are resistant to host-defenses and antibiotic therapy. Moreover, it was surprising to find that a combination of at least two to at least five bacteriophages were effective against more bacterial strains than any single bacteriophage alone. While not wishing to be bound by any theory or hypothesis, different phages, when brought together, can exert a synergistic effect and thus are able to infect a greater number of bacterial strains than when each individual phage was evaluated singly against each individual strain. Additionally, it could be that a pairwise combination of phages can have the ability to kill a single strain while neither phage was effective alone against the strain. Bacteriophages in a cocktail are further more effective than individual bacteriophages in suppressing or delaying the emergence of BIMS. The synergism of bacteriophages in a cocktail whose phage composition is listed in Table 3 is described in Examples 2 and 7, and illustrated in FIGS. 1A, 1B and 6.

Despite the apparent large heterogeneity among coliform mastitis isolates, the present application discloses the unexpected result that the use of a cocktail of at least two, of at least three and of at least four different bacteriophages can have a greater than expected host range against mastitis-causing *E. coli*. This was demonstrated by the cocktail's relatively similar activity against New York state clinical *E. coli* mastitis strains when compared to the Washington state strains that were used to originally isolate the phages. Thus, the universal application of a bacteriophage cocktail to help control and prevent *E. coli* mastitis on a variety of geographically distinct dairies can be contemplated. It is noted however, that twenty-seven of the sixty-two coliform mastitis isolates examined (42%) were resistant to each of the four isolated and selected phages. It is proposed that wider host range activity can be achieved by adding additional phages to the tested cocktail. In addition or alternatively, identification and discovery, selection and isolation of phages for designing phage cocktail combinations that can be effective against coliform strains currently found on a particular farm can provide an effective and targeted approach.

Mastitis

The methods and compositions described herein can also be used to treat or prevent mastitis. As used herein the term "mastitis" refers to an inflammation of a mammary gland. In dairy cattle, the mammary gland is commonly referred to as "udder". Mastitis can be caused by a physical injury, introduction of chemicals, viruses, fungus, parasites or, most commonly, bacterial invasion and host reactions to their toxins. "Mastitis" can be used to describe all forms of such inflammation, including subclinical and clinical mastitis: clinical mastitis includes mild, severe, and chronic mastitis. See, for example, Iscovich et al., U.S. Pat. No. 7,958,513.

In subclinical mastitis, no swelling of the breast or udder can be detected nor can there be observable abnormalities in the milk. This type of mastitis can be commonly referred to as "hidden." However, special screening tests including for example, the California Mastitis Test (CMT), the Wisconsin Mastitis Test (WMT) based on an estimation of somatic cell counts (SCC) and the catalase test, can show changes in milk composition and provide an indication of subclinical mastitis.

Clinical mastitis can be mild or severe, and acute or (less commonly) chronic, and can be characterized by the presence of leukocytes in the milk along with physical changes in appearance of the milk, cow, or both. Mild clinical mastitis can involve changes in the milk appearance including presence of flakes or clots, watery milk or other unusual forms of the milk. Mild clinical mastitis can be accompanied by other symptoms including hot, sensitive or swollen breast or udder.

Severe clinical mastitis involves the symptoms of hot, sensitive, firm breast or udder that can be quite painful to the lactating animal. The onset of severe clinical mastitis can often be sudden and the lactating animal may become systemically ill, showing signs of sepsis or toxemia including fever, rapid pulse, depression, weakness and loss of appetite. When the whole lactation system of the animal is affected, the condition can be referred to as acute systemic mastitis. The severe symptoms can also be accompanied with cessation of milk production.

Chronic mastitis can be represented as persistent udder infection, typically in the form of subclinical mastitis, which occasionally can develop into the clinical form and back to the subclinical form. Chronic mastitis can be characterized by hard lump(s) within the mammary gland due to the establishment of bacteria and the formation of connective or scar tissue and occasionally microabcesses.

Individuals may be assessed prior to, during, or after the methods of treating or preventing mastitis described herein. Symptomatic evaluations can include clinical presentation of lethargy, loss of appetite, as well as the appearance of redness, swelling and pain associated with the teat and/or udder in the case of mastitis. The following tests will show changes in milk composition: the California Mastitis Test (CMT), Wisconsin Mastitis Test (WMT) based on an estimation of somatic cell counts (SCC) and the catalase test. Additional testing can include the polymerase chain reaction (PCR), Matrix-Assisted Laser Desorption Ionization-Mass Spectrometry (MALDI-MS) and selective culture of a sample containing the infectious agent in order to identify the agent. Changes in milk composition can document a subclinical to clinical progression of infection, if infection is in one, two, three or all four teats of a cow and if the cow's own immune system has successfully eradicated the infectious organism(s), e.g., bacteria, fungi, yeast or algae.

Preventing and controlling rather than treating active intramammary infections has been emphasized since most clinically affected cows mount a rapid immune response that eliminates bacteria from the mammary gland. Dry cow antibiotic therapy immediately followed by an internal teat sealant is often used to prevent mastitis in dairy herds by clearing up persistent infections at dry-off and preventing and controlling new infections prior to calving. See, for example, Godden et al. J. Dairy Sci. (2003) 86:3899-3911; Bradley, A. J. Vet. J. (2002) 164:116-128; Bradley et al., J. Dairy Sci. (2011) 94:692-704. By combining bacteriophage with an intramammary teat sealant, *E. coli* infections that can cause mastitis can be potentially controlled on conventional dairies with a single dry cow application. Antibiotic use and teat sealant are not permitted on organic dairies. Thus, the use of bacteriophage provides a safe, effective and natural/organic alternative method for preventing and controlling mastitis and avoiding the process of culling mastitis-infected cows and the resulting costly loss of infected dairy cows on an organic dairy farm. It has been suggested that Gram-negative organisms such as *E. coli* cause mastitis during lactation by infecting the cow during her transition period, rather than early in her dry period. Bradley, et al. J. Dairy Sci. 94:692-704 (2011).

Lactating animals give birth once a year in contemporary dairy practices, such that milking continues while the animal is pregnant. At the end of the lactation period, the process of involution is induced in the mammary gland, so as to enable the restoration of the mammary tissue towards the next lactating period. This is referred to "drying off" and serves to maintain comparable milk yields before and after parturition.

In the management of livestock maintained for milk production, controlling each cycle of pregnancy and milking can result in improved milk yields. The process of involution follows the cessation of milk removal that is accompanied by rapid changes in mammary secretion due to specific and sequential changes in both mammary tissue and milk composition, all part of the passing from the lactating to the non-lactating condition. The first stage of involution can be initiated by the onset of apoptosis, triggered by local stimuli and can be reversible by resumption of milk extraction. A second stage of involution can be persistent with resumption of milk secretion only resulting in a subsequent lactating stage following parturition.

Mastitis can arise during the lactating period, the beginning of the dry period at cessation of milking (while the keratin plug is forming in the streak canal) and the dry period. Mastitis risk increases with the induction of involution and can result in an intramammary infection (IMI). IMI can be a result of infection by bacteria, fungi, yeast or algae. The infection can be characterized as clinical, having local clinical signs and milk anomalies or subclinical with decreased production levels and diminished milk quality.

The beginning of the dry period, and so involution, can occur while a cow can still be producing 20 to 40 liters of milk/day. The cow can still have leaking of milk from secretions of the mammary glands, significantly raising the risk of developing IMI. An extended involution process during the dry-off period has been frequently associated with an increased incidence of IMI.

IMI has far reaching economic consequences beginning at the farm and impacting the consumer. Unanticipated expenses include lost production resulting from non-marketable milk due to unacceptable/decreased milk quality, veterinary and pharmaceutical costs for treatment, culling of infected cows resulting in increased labor and accompanying costs for the farmer. The costs associated with mastitis worldwide have reached over $30 Billion annually and are $2 billion annually to the U.S. dairy industry.

The compositions and methods described herein can be used as dry cow therapies. As used herein, the terms "dry cow therapy" or "dry therapy" can refer to an intramammary therapy administered during a non-lactation period. Administration can be immediately after the last milking in a lactation period, at any time during the dry period and up to parturition. Therapy is administered so as to eliminate, treat, control and cure both presumed as well as diagnosed mastitis at the end of the lactation period.

The compositions and methods described herein can also be used as dry cow preventive therapies. As used herein, the term "dry cow preventive/prophylaxis therapy" can refer to an intramammary therapy administered immediately after the last milking in a lactation period as to prevent mastitis from developing during the dry period, and after parturition during the next lactating period.

Other Bacterial Infections

The methods and compositions described herein can also be used to treat or prevent other bacterial infections. The Gram-negative and Gram-positive bacteria targeted by the bacteriophages described herein can be the causative agents for numerous bacterial infections, including but not limited to mastitis, metritis, otitis, dermatitis, cystitis, infections of the eye including endophthalmitis and conjunctivitis, sinusitis and infections of the oral cavity. Infections can be in the folds of skin, eyes, nose, mouth, body cavities, skin, exterior body openings as well as tissues and organs within the body. In particular the infection can be within the teat canal of a lactating animal, a mammary gland, a mammary canal, a mammary streak canal, a gland cistern, a teat cistern, a uterus, an ear canal, an oral cavity, an eye, a sinus and within or in close proximity to epithelial cells.

As used herein, the term "metritis" can refer to the inflammation of the uterine wall. It can also be described as "postpartum metritis" and "puerperal sepsis," occurring within 10-21 days following parturition in a cow.

As used herein the term "otitis" can refer to the inflammation or infection of the ear. It can be subdivided into the terms "otitis externa" to characterized inflammation or infection of the outer ear or ear canal, "otitis media" for inflammation or infection of the middle ear, and otitis interna for inflammation or infection of the inner ear.

As used herein the term "dermatitis" and "autoeczematization" are used interchangeably herein and can refer to the inflammation or infection of the skin due to the reaction to an infection with parasites, fungi, bacteria, viruses as well as allergens, including but not limited to plants, plant oils, arthropods, nematodes and the like.

Methods of Inhibition

In some embodiments, there is provided a method of inhibiting bacterial adhesion, invasion, and/or colonization of epithelial cells in an individual comprising administering to the individual an effective amount of any one of the compositions described herein. In some embodiments, there is provided a method of inhibiting bacterial adhesion in an individual comprising administering to the individual an effective amount of any one of the compositions described herein. In some embodiments, there is provided a method of inhibiting bacterial invasion of epithelial cells in an individual comprising administering to the individual an effective amount of any one of the compositions described herein. In some embodiments, there is provided a method of inhibiting bacterial colonization of epithelial cells in an individual comprising administering to the individual an effective amount of any one of the compositions described herein. In some embodiments, the epithelial cells are located in a tissue selected from the group consisting of a mammary gland, a mammary canal, a uterus, an ear canal, an oral cavity, an eye, a sinus and skin. In some embodiments, the epithelial cells are located in a mammary gland or a mammary canal. In some embodiments, the individual is a dairy cow. In some embodiments, the composition is administered intramammarily. In some embodiments, the individual is subsequently administered a teat sealant. In some embodiments, the composition is administered during a lactating period. In some embodiments, the composition is administered during a dry period. In some embodiments, the composition is administered at the beginning of the dry period at cessation of milking. In some embodiments, the composition is administered during a transition period. In some embodiments, the composition is administered more than once (such as at least about any one of 2, 3, 4, 5, or more times).

In some embodiments, there is provided a method of inhibiting bacterial adhesion, invasion, and/or colonization of epithelial cells in an individual comprising administering to the individual an effective amount of a composition comprising one or more (such as at least 2, 3, 4, or 5) bacteriophages and a delivery vehicle, wherein the one or more bacteriophages target *Escherichia coli*, and wherein the one or more bacteriophages comprise genome sequences having at least about 95% (such as 100%) sequence identity to the genome sequences of one or more bacteriophages selected from the group consisting of p0031, p0032, p0033, p0034, and p0045. In some embodiments, the one or more bacteriophages comprise genome sequences having at least about 95% (such as 100%) sequence identity to one or more sequences selected from the group consisting of SEQ ID NOs: 1-5. In some embodiments, the one or more bacteriophages are selected from the group consisting of p0031, p0032, p0033, p0034, and p0045. In some embodiments, the composition comprises p0031, p0032, p0033, and p0034. In some embodiments, the composition comprises p0031, p0032, p0033, p0034, and p0045. In some embodiments, the composition further comprises one or more bacteriophages targeting one or more Gram-negative bacteria. In some embodiments, the Gram-negative bacteria are selected from the group consisting of *Escherichia coli*, *Enterobacter* spp., *Citrobacter* spp., and *Klebsiella* spp., *Hafnia* spp., *Corynebacterium pyogenes*, *Mycoplasma bovis*, *Serratia* spp., *Pasteurella* spp., *Proteus* spp., *Campylobacter* ssp., *Salmonella* ssp., *Pseudomonas aeruginosa*, and *Brucella melitensis*. In some embodiments, the composition further comprises one or more additional bacteriophages targeting one or more Gram-positive bacteria. In some embodiments, the Gram-positive bacteria are selected from the group consisting of *Staphylococcus aureus*, *Streptococcus agalactiae*, *Streptococcus uberis*, *Streptococcus dysgalactiae*, *Streptococcus equinus*, *Staphylococcus hyicus*, *Staphylococcus simulans*, *Staphylococcus epidermidis*, *Staphylococcus chromogenes*, *Staphylococcus xylosus*, coagulase negative Stapholococci (CNS), *Corynebacterium bovis*, *Pasteurella* spp., *Trueperella pyogenes*, *Clostridium perfingens*, *Clostridium difficile*, and *Listeria* ssp. In some embodiments, the epithelial cells are located in a tissue selected from the group consisting of a mammary gland, a mammary canal, a uterus, an ear canal, an oral cavity, an eye, a sinus and skin. In some embodiments, the epithelial cells are located in a mammary gland or a mammary canal. In some embodiments, the individual is a dairy cow. In some embodiments, the composition is administered intramammarily. In some embodiments, the individual is subsequently administered a teat sealant. In some embodiments, the composition is administered during a lactating period. In some embodiments, the composition is administered during a dry period. In some embodiments, the composition is administered at the beginning of the dry period at cessation of milking. In some embodiments, the composition is administered during a transition period. In some embodiments, the composition is administered more than once (such as at least about any one of 2, 3, 4, 5, or more times).

In some embodiments, there is provided a method for preventing, treating and reversing a bacterial colonization, comprising administering to an animal a composition having a delivery vehicle, and a bacteriophage cocktail. In some embodiments, the method can be for preventing a bacterial colonization in an animal comprising administering to the animal an effective amount of a composition having a delivery vehicle, and a bacteriophage cocktail. In some embodiments, the method can be for treating a bacterial colonization in an animal comprising administering to the animal an effective amount of a composition having a delivery vehicle, and a bacteriophage cocktail. In some embodiments, the method can be for controlling a bacterial colonization in an animal comprising administering to the animal an effective amount of a composition having a delivery vehicle, and a bacteriophage cocktail. In some embodiments, the bacteriophage of the methods can be lytic to a Gram-negative bacteria. In some embodiments, the bacteriophage of the methods can be lytic to a Gram-positive bacteria. In some embodiments, the bacteria causes bacterial colonization selected from the group consisting mastitis, metritis, otitis, dermatitis, cystitis, infections of the eye including endophthalmitis and conjunctivitis, sinusitis and infections of the oral cavity. In some embodiments, the bacterial colonization can be caused by one or more strains of *Escherichia coli*, *Pseudomonas aeruginosa*, *Corynebacterium pyogenes*, *Mycoplasma bovis*, *Serratia*, *Klebsiella*, *Campylobacter*, *Salmonella*, or *Enterobacter*. In some embodiments, the bacterial colonization can be caused by one or more strains of *Staphylococcus aureus*, *Streptococcus agalactiae*, *Streptococcus uberis*, *Streptococcus dysgalactiae*, *Streptococcus equinus*, *Staphylococcus hyicus*, *Staphylococcus simulans*, *Staphylococcus epidermidis*, *Staphylococcus chromogenes*, *Staphylococcus xylosus*, coagulase negative Stapholococci, or *Listeria* spp. In some embodiments, the methods can be used for the treatment of a disease, wherein the disease is mastitis. In some embodiments, of the methods, the animal administered the disclosed composition is capable of lactating, wherein the animal can be at a time period selected from the group consisting of the dry period, the lactating period and the beginning of the dry period at cessation of milking. In some embodiments, the mastitis resides in a mammary gland. In some embodiments, the composition of the methods can be administered to at least once to a colonized mammary gland of the animal. In some embodiments, the composition of the methods can administered to a teat canal of the animal. In some embodiments, the composition of the methods can have continuous contact with epithelial cells of the mammary gland wherein the epithelial cells are located in an area selected from the group consisting of a mammary gland, a mammary canal, a uterus, an ear canal, an oral cavity, an eye, a sinus and skin.

Epithelial cells, comprising epithelium tissue, comprise one of four basic animal tissues, the other tissues being connective tissue, muscle tissue and nervous tissue. The linings of body cavities as well as the surfaces of organs and blood vessels are lined with epithelial tissues. Epithelial cells can be of squamous, columnar and cuboidal in shape, in single or two or more cell layers. Epithelial cells function in secretion, selective absorption, protection, transcellular transport and sensing. In some embodiments, the epithelial cells are located in a tissue selected from the group consisting of a mammary gland, a mammary canal, a uterus, an ear canal, an oral cavity, an eye, a sinus and skin. Without being bound by any theory or hypothesis, bacterial adhesion, invasion, and/or colonization of epithelial cells in the mammary gland or mammary canal cause mastitis.

Bacterial adhesion, invasion and/or colonization in epithelial cells may be monitored using any known methods in the art, including, for example, by microscopy. Example 4 further describes methods of quantifying bacterial adhesion, invasion and/or colonization in epithelial cells in vitro. In some embodiments, the method inhibits bacterial adhesion to the epithelial cells by at least about any one of 10%, 20%, 30%, 40%, 50%, 60%, 70%, 80%, 90%, 95%, 99%, 99.9%, 99.99%, or more. In some embodiments, the method inhibits bacterial invasion to the epithelial cells by at least about any one of 10%, 20%, 30%, 40%, 50%, 60%, 70%, 80%, 90%, 95%, 99%, 99.9%, 99.99%, or more. In some embodiments, the method inhibits bacterial colonization in epithelial cells by at least about 10%, 20%, 30%, 40%, 50%, 60%, 70%, 80%, 90%, 95%, 99%, 99.9%, 99.99%, or more. To achieve the desired level of inhibition, the composition is in contact with the epithelial cells for a sufficient amount of time, such as at least about any one of 1 hour, 2 hours, 4 hours, 6 hours, 12 hours, 24 hours, 36 hours, 48 hours, 3 days, 4 days, 5 days, 6 days, 7 days, or more.

In some embodiments, there is provided a method of suppressing bacteriophage-insensitive mutants of a bacterium in a target composition or an individual, comprising administering to the individual an effective amount of any one of the compositions described herein, wherein the composition comprises at least two (such as at least 3, 4, 5, 6, or more) bacteriophages targeting the bacterium. In some embodiments, the bacterium is a coliform bacterium. In some embodiments, the bacterium is *E. coli*. In some embodiments, the composition comprises at least 2 (such as at least 3, 4, 5, 6 or more) bacteriophages and a delivery vehicle, wherein the at least two bacteriophages target *Escherichia coli*, and wherein the at least two bacteriophages comprise genome sequences having at least about 95% (such as 100%) sequence identity to the genome sequences of at least two bacteriophages selected from the group consisting of p0031, p0032, p0033, p0034, and p0045. In some embodiments, the at least two bacteriophages comprise genome sequences having at least about 95% (such as 100%) sequence identity to at least two sequences selected from the group consisting of SEQ ID NOs: 1-5. In some embodiments, the at least two bacteriophages are selected from the group consisting of p0031, p0032, p0033, p0034, and p0045. In some embodiments, the composition comprises p0031, p0032, p0033, and p0034. In some embodiments, the composition comprises p0031, p0032, p0033, p0034, and p0045. In some embodiments, the method delays emergence of the BIMs by at least about any of 12 hours, 1 day, 2 days, 3 days, 4 days, 6 days, 1 week, 2 weeks, 3 weeks, 4 weeks or more.

The bacteriophage compositions described herein may further be useful for inhibiting bacterial growth in a target composition in vitro, such as a food composition, including dairy products.

In some embodiments, there is provided a method of inhibiting bacterial growth in a target composition comprising contacting the target composition with an effective amount of any one of the compositions described herein. In some embodiments, the target composition is an in vitro composition. In some embodiments, the target composition is raw milk. In some embodiments, the contacting occurs at more than 25° C.

In some embodiments, there is provided a method of inhibiting bacterial growth in a target composition comprising contacting the target composition with an effective amount of a composition comprising one or more (such as at least 2, 3, 4, or 5) bacteriophages and a delivery vehicle, wherein the one or more bacteriophages target *Escherichia coli*, and wherein the one or more bacteriophages comprise genome sequences having at least about 95% (such as 100%) sequence identity to the genome sequences of one or more bacteriophages selected from the group consisting of p0031, p0032, p0033, p0034, and p0045. In some embodiments, the one or more bacteriophages comprise genome sequences having at least about 95% (such as 100%) sequence identity to one or more sequences selected from the group consisting of SEQ ID NOs: 1-5. In some embodiments, the one or more bacteriophages are selected from the group consisting of p0031, p0032, p0033, p0034, and p0045. In some embodiments, the composition comprises p0031, p0032, p0033, and p0034. In some embodiments, the composition comprises p0031, p0032, p0033, p0034, and p0045. In some embodiments, the composition further comprises one or more bacteriophages targeting one or more Gram-negative bacteria. In some embodiments, the Gram-negative bacteria are selected from the group consisting of *Escherichia coli, Enterobacter* spp., *Citrobacter* spp., and *Klebsiella* spp., *Hafnia* spp., *Corynebacterium pyogenes, Mycoplasma bovis, Serratia* spp., *Pasteurella* spp., *Proteus* spp., *Campylobacter* ssp., *Salmonella* ssp., *Pseudomonas aeruginosa,* and *Brucella melitensis*. In some embodiments, the composition further comprises one or more additional bacteriophages targeting one or more Gram-positive bacteria. In some embodiments, the Gram-positive bacteria are selected from the group consisting of *Staphylococcus aureus, Streptococcus agalactiae, Streptococcus uberis, Streptococcus dysgalactiae, Streptococcus equinus, Staphylococcus hyicus, Staphylococcus simulans, Staphylococcus epidermidis, Staphylococcus chromogenes, Staphylococcus xylosus,* coagulase negative Stapholococci (CNS), *Corynebacterium bovis, Pasteurella* spp., *Trueperella pyogenes, Clostridium perfingens, Clostridium difficile,* and *Listeria* ssp. In some embodiments, the target composition is an in vitro composition. In some embodiments, the target composition is raw milk. In some embodiments, the contacting occurs at more than 25° C. In some embodiments, the composition further comprises a de-agglomeration agent, such as a protease. In some embodiments, the composition further comprises an adjuvant composition for the de-agglomeration agent, such as a chelating agent and a reducing agent.

The methods of inhibiting bacterial growth described herein can occur at a temperature higher than 25° C., such as at any one of 26° C., 27° C., 28° C., 29° C., 30° C., 31° C., 32° C., 33° C., 34° C., 35° C., 36° C., 37° C., 38° C., or more. In some embodiments, the composition is contacted with the target composition at a physiological temperature. In some embodiments, the composition is contacted with the target composition for at least about any one of 1 hour, 2 hours, 3 hours, 4 hours, 6 hours, 8 hours, 12 hours, 16 hours, 20 hours, 24 hours, or more. In some embodiments, the effective amount of the bacteriophage(s) in the composition to the bacterial cells in the target compositions is at least about any one of 1, 5, 10, 20, 50, 100, 200, 500, 1000, or more MOI.

Bacteriophages are commonly found in raw milk samples and can create problems for cheese and yogurt processors by infecting starter bacterial cultures. Madera et al. Appl. Environ. Microbiol. (2004) 70:7365-7371; García et al. J. Dairy Sci. (2009) 92:3019-3026. It appears that in a raw milk medium, bacteriophage interact with *E. coli* differently than they do with *S. aureus* allowing phage to effectively inhibit growth of *E. coli*. Recent successful control programs for contagious mastitis pathogens, *S. aureus* and *Streptococcus agalactiae*, have increased the relative impact of environmental mastitis-causing organism such as *E. coli* and *Streptococcus uberis* (Zadoks, R., and J. Fitzpatrick. Ir Vet J. (2009) 62 Suppl 4. S59-70). It is not known whether Streptococcal bacteria avoid bacteriophage infection in raw milk in a similar fashion to Staphylococcal bacteria. Although staphylococcal bacteriophage K is able to inhibit growth of *Staphylococcus aureus* in pasteurized milk, it is unable to affect bacterial growth in raw milk due to bacterial agglutination which prevents phage binding (O'Flaherty et al., *Lett. Appl. Microbiol.* 41:274-279, 2005). Heat-treating milk whey inactivates whey proteins, allowing phage to bind and lyse *S. aureus* effectively (Gill et al., *J. Appl. Microbiol.* 101 377-386, 2006; Gill et al., Antimicrob. Agents Chemother. (2006) 50:2912-2918). More recently, it has been shown that *E. coli* can be completely eliminated by phages in raw milk at an incubation temperature of 25° C. (McLean, et al., Foodborne Pathog. Dis. (2013) 10:956-962). In the present application, it was surprisingly demonstrated that bacteriophages described herein can bind to, replicate, and lyse *E. coli* in the presence of raw milk constituents and significantly reduce bacterial titers after twelve hours of growth at physiologic temperature.

Methods of Administration

The compositions described herein may be administered using a variety of administration protocols.

Suitable routes of administration include, but are not limited to, parenteral, percutaneous, subcutaneous, intramuscular, intravenous, intraperitoneal, intrapleural, intravesicular or intrathecal, topical, oral, rectal, inhalation, ocular, otic, or nasal route by implant and also by dipping routes of administration. One skilled in the art can choose an appropriate route of administration based on the site of infection, severity of disease, infectious agent and the disease. In some embodiments, the composition is administered systemically. In some embodiments, the composition is administered by intramuscular, subcutaneous, or intravenous injection. In some embodiments, the composition is administered locally, for example to the tissue or body part that has the bacterial infection. In some embodiments, wherein the bacterial infection is in the mammary gland, the composition is administered intramammarily. In some embodiments, the composition is administered by intramammary injection. In some embodiments, wherein the bacterial infection is dermatitis, pododermatitis, or infection to the skin, the composition is administered topically. In some embodiments, wherein the bacterial infection is in the eye, the composition is administered ophthalmically. In some embodiments, wherein the bacterial infection is in the uterus, the composition is administered intrauterinely. In some embodiments, wherein the bacterial infection is in the bladder, the composition is administered intravesically. In some embodiments, wherein the bacterial infection is in the mouth or gastrointestinal track, the composition is administered orally. In some embodiments, wherein the bacterial infection is in the nose, the composition is administered intranasally. In some embodiments, wherein the bacterial infection is in the respiratory tract, the composition is administered by inhalation.

When prepared as injectables, the bacteriophages disclosed herein can be generally administered using a pharmaceutically acceptable vehicle or excipient. Suitable vehicles are, for example, water, saline, mannitol, dextran, amino acids, glycerol, or the like, in various combinations, in addition, if desired, the vehicle may contain auxiliary substances such as wetting or emulsifying agents, preservatives and pH buffering agents. The active ingredient will typically range from about 0.001% to about 95% (w/w) of the composition administered, or even higher or lower if appropriate.

Parenteral administration may be conventionally accomplished by subcutaneous, intradermal, intramuscular, and intravenous injection. Needle-less air-blast injection devices may be equally useful. Parenteral administration is well known in the art and may be carried out in ways usual in the animal veterinary or human medical art.

It is also envisioned that either by oral administration or injection of the bacteriophage compositions described herein directly into the bloodstream the bacterial infection can be eliminated, or the composition can significantly reduce the number of targeted bacteria in the blood. If, after either oral or local administration, phages get into the bloodstream in sufficient numbers to eliminate bacteria from the bloodstream, septicemia may be treated by administering the bacteriophage compositions orally or locally. If the phages do not get into the bloodstream in sufficient numbers to eliminate bacteria from the bloodstream, the utility of direct intravenous injection of phages for treating septic infections can be used to treat bloodstream infections caused by pathogenic bacteria, and can provide an urgently needed means for dealing with currently untreatable septicemic infections.

In some embodiments, the composition is administered to the individual once. In some embodiments, the composition is administered to the individual for more than once (such as at least about any one of 2, 3, 4, 5, 6, or more times). In some embodiments, the composition (such as bacteriophage cocktail) is administered at least once (such as at least about any one of 2, 3, 4, 5, 6, or more times) at the beginning of the dry period. In some embodiments, the composition (such as bacteriophage cocktail) is administered at least once (such as at least about any one of 2, 3, 4, 5, 6, or more times) during the dry period. In some embodiments, the composition (such as bacteriophage cocktail) is administered at least once (such as at least about any one of 2, 3, 4, 5, 6, or more times) during the lactating period. In some embodiments, the composition is administered for about 3 times at consecutive milkings. In some embodiments, the composition (such as bacteriophage cocktail) is administered at least once (such as at least about any one of 2, 3, 4, 5, 6, or more times) during the transition period.

In some embodiments, the effective amount of the bacteriophage(s) in the composition is at least about any one of $10^4$, $10^5$, $10^6$, $10^7$, $10^8$, $10^9$, $10^{10}$, $10^{11}$, or $10^{12}$ plaque-forming units (PFU). In some embodiments, the effective amount of the bacteriophage(s) in the composition is any of between about $10^4$ and about $10^{12}$ plaque-forming units (PFU) per ml, between about $10^6$ and about $10^{11}$ PFU, or between about $10^7$ and about $10^{10}$ PFU. In some embodiments, the effective amount of the bacteriophage(s) in the composition is at least about any one of 0.0001, 0.001, 0.01, 0.1, 1, 2, 5, 10, 15, 20, 25, 30, 40, 50, 60, 70, 80, 90, 100, 1000 or more Multiplicity of Infection (MOI) with respect to the bacterial cells. In some embodiments, the effective amount of the bacteriophage(s) in the composition is about any of 0.0001-0.001, 0.001-0.01, 0.01-0.1, 0.1-1, 1-2, 2-5, 5-10, 10-15, 15-20, 20-25, 25-30, 30-40, 40-50, 50-100, 1-10, 10-50, 50-100, 100-1000, 0.0001-1, 1-1000, or 0.0001-1000 MOI with respect to the bacterial cells.

The bacteriophage(s) and the delivery vehicle can be administered simultaneously or sequentially. In some embodiments, the bacteriophage cocktail is administered to the individual before the delivery vehicle. In some embodiments, the delivery vehicle is administered before the bacteriophage cocktail. Alternatively, the delivery vehicle and bacteriophage cocktail are combined. The combination of delivery vehicle and bacteriophage cocktail can occur in vitro or in vivo. The delivery vehicle and cocktail can be combined into a slurry, emulsion, paste, amalgam, mixture and composite. The combination of delivery vehicle and bacteriophage cocktail can be administered at least once at the beginning of the dry period. The combination of the delivery vehicle and bacteriophage cocktail can be administered at least once during the dry period. The combination of delivery vehicle and bacteriophage cocktail can be administered at least once during the lactating period.

In some embodiments, the method comprises administering a composition comprising the bacteriophage(s) and the delivery vehicle to the individual, followed by administering a teat sealant or a teat dip to the individual. In some embodiments, the intramammary teat sealant is antibiotic free. The teat sealant can form a physical barrier in the teat duct and sinus to prevent entrance of environmental pathogens, is non-toxic and can be easily removable. Table 2 provides a selection of intramammary teat sealants, but is not to be construed as exhaustive or limiting.

TABLE 2

| Product | Active Ingredients | Manufacturer |
| --- | --- | --- |
| ORBESEAL ® sealant | 65% (w/w) Bismuth subnitrate, administered in a 4 g intramammary paste by syringe | Pfizer Animal Health/Zoetis |
| TEATSEAL ® | 25-65% (w/w) Bismuth subnitrate, 0.075% (w/w) acriflavine in a paraffin/wax base | Osmonds & Sons (Dublin) Ltd., Broomhill Road, Tallaght, Co. Dublin, IRELAND Meaney, W. J. (1977) Ir. J. Agric. Res. 16: 293-299. |

In some embodiments, the composition is administered using an injection device, infusion device, an applicator, and a plunger or plastic syringe. The composition components, alone and/or in combination can be applied into the udder's teat canal for intramammary administration to provide continuous contact of the bacteriophage cocktail, and/or the combination of delivery vehicle and bacteriophage cocktail with the epithelial cells of at least one of the teat canal, mammary duct, milk gland and mammary tissue. The bacteriophage cocktail, and/or the combination of delivery vehicle and bacteriophage cocktail can be applied by any mechanism such that the bacteriophage cocktail, and/or the combination of delivery vehicle and cocktail can enter, fill with a pre-determined amount and remain within the teat opening, the teat canal, mammary duct, milk gland and mammary tissue. The bacteriophage cocktail, and/or the combination of delivery vehicle and bacteriophage cocktail in combination with a teat seal or teat dip can also act as a barrier to prevent the entrance of infectious organisms into the udder's teat orifice and up and into the teat canal.

In some embodiments, the composition is administered to an animal capable of lactating. In some embodiments, the composition is administered to a teat canal of an animal, wherein the animal can be at a time period selected from the group consisting of the dry period, the lactating period and the beginning of the dry period at cessation of milking. In some embodiments, the animal to whom the composition or at least one component of the composition can be administered can be selected from the group consisting of a cow, a goat, a sheep, a buffalo, a camel, a donkey, a llama, a horse, a pig, a human, a primate, an avian, a fish, a mule, a cat and a dog. In some embodiments, the composition of the methods can be in continuous contact with epithelial cells, wherein the epithelial cells are located in an area selected from the group consisting of a mammary gland, a mammary canal, a uterus, an ear canal, an oral cavity, an eye, a sinus and skin.

The administration of the composition of at least two bacteriophages and the delivery vehicle, of at least three bacteriophages and the delivery vehicle, and of at least four bacteriophages and the delivery vehicle can occur as a mixed composition of phages and delivery vehicle, as first administering the phages and then the delivery vehicle, as a combination of phages and a delivery vehicle administered alone or combined during administration and as administering the phages and then administering the delivery vehicle through a single needle-like apparatus attached to a dual-barreled syringe, for example. In some embodiments, the delivery vehicle can be a reformulated mastitis product as listed in Table 1, a teat sealant or a teat dip. In some embodiments the teat sealant can be replaced by a teat dip as is known to one of skill in the art.

IV. Kits and Articles of Manufacture

The present invention further provides kits, and articles of manufacture (such as products) comprising any of the compositions described herein.

In some embodiments, there is provided a kit comprising a composition comprising a plurality of isolated, selected bacteriophages and a delivery vehicle in a suitable container.

In some embodiments, there is provided a kit comprising a composition comprising one or more (such as at least 2, 3, 4, or 5) bacteriophages and a delivery vehicle, wherein the one or more bacteriophages target *Escherichia coli*, and wherein the one or more bacteriophages comprise genome sequences having at least about 95% (such as 100%) sequence identity to the genome sequences of one or more bacteriophages selected from the group consisting of p0031, p0032, p0033, p0034, and p0045. In some embodiments, the one or more bacteriophages comprise genome sequences having at least about 95% (such as 100%) sequence identity to one or more sequences selected from the group consisting of SEQ ID NOs: 1-5. In some embodiments, the one or more bacteriophages are selected from the group consisting of p0031, p0032, p0033, p0034, and p0045. In some embodiments, the composition comprises p0031, p0032, p0033, and p0034. In some embodiments, the composition comprises p0031, p0032, p0033, p0034, and p0045. In some embodiments, the composition further comprises one or more bacteriophages targeting one or more Gram-negative bacteria. In some embodiments, the Gram-negative bacteria are selected from the group consisting of *Escherichia coli, Enterobacter* spp., *Citrobacter* spp., and *Klebsiella* spp., *Hafnia* spp., *Corynebacterium pyogenes, Mycoplasma bovis, Serratia* spp., *Pasteurella* spp., *Proteus* spp., *Campylobacter* ssp., *Salmonella* ssp., *Pseudomonas aeruginosa,* and *Brucella melitensis*. In some embodiments, the composition further comprises one or more additional bacteriophages targeting one or more Gram-positive bacteria. In some embodiments, the Gram-positive bacteria are selected from the group consisting of *Staphylococcus aureus, Streptococcus agalactiae, Streptococcus uberis, Streptococcus dysgalactiae, Streptococcus equinus, Staphylococcus hyicus, Staphylococcus simulans, Staphylococcus epidermidis, Staphylococcus chromogenes, Staphylococcus xylosus,* coagulase negative Staphylococci (CNS), *Corynebacterium bovis, Pasteurella* spp., *Trueperella pyogenes, Clostridium perfingens, Clostridium difficile,* and *Listeria* ssp. In some embodiments, the kit further comprises instructions for treating or preventing a disease caused by a bacterial infection. In some embodiments, the kit further comprises a teat sealant. In some embodiments, the kit further comprises a device for intramammary administration. In some embodiments, the device is a syringe.

In some embodiments, the kit further comprises additional reagents including but not limited to phage buffer, TSB, phosphate buffered saline (PBS), ingredients for making phage buffer (100 mM NaCl, 100 mM Tris-HCl, 0.01% (w/v) Gelatin), paraffin wax, food grade oil(s), and inorganic salts useful for adjusting the viscosity of the delivery vehicle and for detection of the vehicle once infused. The kit can further contain reagents for propagating the bacteriophage (s), and the bacterial strains selective for each enclosed, isolated phage, agar and/or agar petri dishes. The kit can further contain a device for infusion of the bacteriophage composition, teat sealant, and combination composition into the teat canal, teat sinuses and folds, such as an injection device, infusion device, an applicator, a plunger or plastic syringe.

The containers of the kits can include at least one vial, test tube, flask, bottle, syringe or other containers, into which a component can be placed, and preferably, suitably aliquoted. Where there can be more than one component in the kit, the kit also can contain a second, third or other additional container into which the additional components can be separately placed. However, various combinations of components can be included in a container.

When the components of the kit can be provided in one or more liquid solutions, the liquid solution can be an aqueous solution. However, the components of the kit can be provided as dried powder(s). When reagents and/or components are provided as a dry powder, the powder can be reconstituted by the addition of a suitable solvent.

The kit can contain implements to aid in the aseptic application of the product including but not limited to alcohol swabs, wipes, towelettes, gloves, soaps or cleaning agents. The kit can include instructions for employing the kit components as well the use of any other reagent not included in the kit. Instructions can include variations that can be implemented.

The kits of the present application are in suitable packaging. Suitable packaging includes, but is not limited to, vials, cans (such as pressurized can), bottles, jars, flexible packaging (e.g., Mylar or plastic bags), and the like. Kits may optionally provide additional components such as buffers and interpretative information. The present application thus also provides articles of manufacture, which include vials, cans (such as pressurized can), bottles, jars, flexible packaging, and the like.

The kits and articles of manufacture may contain unit doses, bulk packages (e.g., multi-dose packages) or sub-unit doses. For example, kits may be provided that contain sufficient amount of the bacteriophage composition for any of 1, 2, 3, 4, 5, 6, 7, 8, 9, 10, 20, 50, 100 or more applications.

The instructions in the kits contain information generally related to the methods of the treatment or prevention described herein, including, for example, the effective amount, frequency, and application routes. The instructions may further contain information related to the storage, and safety information for using the bacteriophage compositions.

V. Deposit of Biological Material

The following biological materials have been deposited with the International Depositary Authority of Canada, 1015 Arlington Street, Winnipeg, R3E 3R2, Canada (IDAC):

| Identification reference | IDAC Accession Number | Deposit Date |
|---|---|---|
| Bacteriophage p0031 | 161116-01 | Nov. 16, 2016 |
| Bacteriophage p0032 | 161116-02 | Nov. 16, 2016 |
| Bacteriophage p0033 | 161116-03 | Nov. 16, 2016 |
| Bacteriophage p0034 | 101116-01 | Nov. 16, 2016 |
| Bacteriophage p0045 | 161116-04 | Nov. 16, 2016 |
| *E. coli* b010h | 161116-05 | Nov. 16, 2016 |

This deposit was made under the provisions of the Budapest Treaty on the International Recognition of the Deposit of Microorganisms for the Purpose of Patent Procedure and the Regulations thereunder (Budapest Treaty). This assures the maintenance of a viable culture of the deposit for 30 years from the date of deposit and for at least five (5) years after the most recent request for furnishing of a sample of the deposit. The deposit will be made available by the IDAC under the terms of the Budapest Treaty, and subject to an agreement between Epibiome, Inc., and the IDAC, which assures that all restrictions imposed by the depositor on the availability to the public of the deposited material will be irrevocably removed upon the granting of the pertinent U.S. patent, assures permanent and unrestricted availability of the progeny of the culture of the deposit to the public upon issuance of the pertinent U.S. patent or upon laying open to the public of any U.S. or foreign patent application, whichever comes first, and assures availability of the progeny to one determined by the U.S. Commissioner of Patents and Trademarks to be entitled thereto according to 35 U.S.C. § 122 and the Commissioner's rules pursuant thereto (including 37 C.F.R. § 1.14 with particular reference to 886 OG 638).

VI. Exemplary Embodiments

Embodiment 1. In some embodiments, there is provided a composition comprising: a). a delivery vehicle, and b). a bacteriophage cocktail.

Embodiment 2. In some further embodiments of embodiment 1, the delivery vehicle is selected from a bismuth-free and a bismuth-containing vehicle.

Embodiment 3. In some further embodiments of embodiment 1 or embodiment 2, the bacteriophage cocktail is a combination of at least two different, isolated bacteriophages.

Embodiment 4. In some further embodiments of any one of embodiments 1-3, the composition is used in the prevention of infection of an animal.

Embodiment 5. In some further embodiments of embodiment 4, the infection is a bacterial infection.

Embodiment 6. In some further embodiments of any one of embodiments 1-5, each bacteriophage is a lytic phage.

Embodiment 7. In some further embodiments of any one of embodiments 1-6, at least one bacteriophage is lytic to a Gram-negative bacterium.

Embodiment 8. In some further embodiments of embodiment 7, the Gram-negative bacteria causes a bacterial infection selected from the group consisting of mastitis, metritis, otitis, dermatitis, cystitis, infections of the eye including endophthalmitis and conjunctivitis, sinusitis and infections of the oral cavity.

Embodiment 9. In some further embodiments of embodiment 8, the bacterial infection is caused by one or more strains of *Escherichia coli, Pseudomonas aeruginosa, Corynebacterium pyogenes, Mycoplasma bovis, Serratia* ssp., *Klebsiella* ssp., *Campylobacter* ssp., *Salmonella* ssp., or *Enterobacter* ssp.

Embodiment 10. In some further embodiments of any one of embodiments 1-9, at least one bacteriophage is lytic to Gram-positive bacteria.

Embodiment 11. In some further embodiments of embodiment 10, the Gram-positive bacteria causes bacterial infection selected from the group consisting of mastitis, metritis, otitis, dermatitis, cystitis, infections of the eye including endophthalmitis and conjunctivitis, sinusitis and infections of the oral cavity.

Embodiment 12. In some further embodiments of embodiment 10, the bacterial infection is caused by one or more strains of *Staphylococcus aureus, Streptococcus agalactiae, Streptococcus uberis, Streptococcus dysgalactiae, Streptococcus equinus, Staphylococcus hyicus, Staphylococcus simulans, Staphylococcus epidermidis, Staphylococcus chromogenes, Staphylococcus xylosus*, coagulase negative Stapholococci, or *Listeria* spp.

Embodiment 13. In some further embodiments of any one of embodiments 1-12, the composition is administered to an animal capable of lactating.

Embodiment 14. In some further embodiments of embodiment 13, the composition is administered to a teat canal of an animal.

Embodiment 15. In some further embodiments of embodiment 13 or embodiment 14, the animal is at a time period selected from the group consisting of the dry period, the lactating period and the beginning of the dry period at cessation of milking.

Embodiment 16. In some further embodiments of any one of embodiments 1-15, the animal is selected from the group consisting of a cow, a goat, a sheep, a buffalo, a camel, a donkey, a llama, a horse, a pig, a human, a primate, an avian, a fish, a mule, a cat and a dog.

Embodiment 17. In some embodiments, there is provided a composition comprising a therapeutically effective amount of a bacteriophage cocktail, wherein the cocktail comprises at least two different isolated bacteriophages, and the bacteriophage cocktail is combined with a vehicle carrier and the therapeutically effective amount is sufficient to treat a bacterial infection.

Embodiment 18. In some further embodiments of embodiment 17, the delivery vehicle is selected from a bismuth-free and a bismuth-containing vehicle.

Embodiment 19. In some further embodiments of embodiment 17 or embodiment 18, the composition is used in the treatment of infection of an animal.

Embodiment 20. In some further embodiments of any one of embodiments 17-19, each bacteriophage is a lytic phage.

Embodiment 21. In some further embodiments of any one of embodiments 17-20, at least one bacteriophage is lytic to a Gram-negative bacterium.

Embodiment 22. In some further embodiments of embodiment 21, the Gram-negative bacteria cause the bacterial infection selected from the group consisting of mastitis, metritis, otitis, dermatitis, cystitis, infections of the eye including endophthalmitis and conjunctivitis, sinusitis and infections of the oral cavity.

Embodiment 23. In some further embodiments of embodiment 22, the bacterial infection is caused by one or more strains of *Escherichia coli, Pseudomonas aeruginosa, Corynebacterium pyogenes, Mycoplasma bovis, Serratia* ssp., *Klebsiella* ssp., *Campylobacter* ssp., *Salmonella* ssp., or *Enterobacter* ssp.

Embodiment 24. In some further embodiments of any one of embodiments 17-23, at least one bacteriophage is lytic to Gram-positive bacteria.

Embodiment 25. In some further embodiments of embodiment 24, the Gram-positive bacteria causes bacterial infection selected from the group consisting of mastitis, metritis, otitis, dermatitis, cystitis, infections of the eye including endophthalmitis and conjunctivitis, sinusitis and infections of the oral cavity.

Embodiment 26. In some further embodiments of embodiment 25, the bacterial infection is caused by one or more strains of *Staphylococcus aureus, Streptococcus agalactiae, Streptococcus uberis, Streptococcus dysgalactiae, Streptococcus equinus, Staphylococcus hyicus, Staphylococcus simulans, Staphylococcus epidermidis, Staphylococcus chromogenes, Staphylococcus xylosus*, coagulase negative Stapholococci, or *Listeria* spp.

Embodiment 27. In some further embodiments of any one of embodiments 17-26, the composition is administered to an animal capable of lactating.

Embodiment 28. In some further embodiments of embodiment 27, the composition is administered to a teat canal of an animal.

Embodiment 29. In some further embodiments of embodiment 27 or embodiment 28, the animal is at a time period selected from the group consisting of the dry period, the lactating period and the beginning of the dry period at cessation of milking.

Embodiment 30. In some further embodiments of any one of embodiments 17-29, the animal is selected from the group consisting of a cow, a goat, a sheep, a buffalo, a camel, a donkey, a llama, a horse, a pig, a human, a primate, an avian, a fish, a mule, a cat and a dog.

Embodiment 31. In some embodiments, there is provided a method for preventing, treating and reversing a bacterial infection, comprising administering to an animal a composition according to any one of embodiments 1-12.

Embodiment 32. In some embodiments, there is provided a method of preventing a bacterial infection in an animal comprising administering to the animal an effective amount of a composition according to any one of embodiments 1-12.

Embodiment 33. In some embodiments, there is provided a method of treating a bacterial infection in an animal comprising administering to the animal an effective amount of a composition according to any one of embodiments 1-12.

Embodiment 34. In some embodiments, there is provided a method of controlling a bacterial infection in an animal comprising administering to the animal an effective amount of a composition according to any one of embodiments 1-12.

Embodiment 35. In some further embodiments of any one of embodiments 31-34, the composition has continuous contact with epithelial cells.

Embodiment 36. In some further embodiments of embodiment 35, the epithelial cells are located in an area selected from the group consisting of a mammary gland, a mammary canal, a uterus, an ear canal, an oral cavity, an eye, a sinus and skin.

Embodiment 37. In some further embodiments of any one of embodiments 31-36, the bacterial infection causes mastitis.

Embodiment 38. In some further embodiments of any one of embodiments 31-37, the animal administered the composition is capable of lactating.

Embodiment 39. In some further embodiments of any one of embodiments 31-38, the animal is at a time period selected from the group consisting of the dry period, the lactating period and the beginning of the dry period at cessation of milking.

Embodiment 40. In some further embodiments of any one of embodiments 37-39, the mastitis resides in a mammary gland.

Embodiment 41. In some further embodiments of any one of embodiments 37-40, the composition is administered to at least one infected mammary gland of the animal.

Embodiment 42. In some further embodiments of any one of embodiments 37-41, the composition is administered to a teat canal of the animal.

Embodiment 43. In some further embodiments of any one of embodiments 37-42, the composition has continuous contact with epithelial cells of the mammary gland.

Embodiment 44. In some further embodiments of any one of embodiments 31-43, the composition is administered by an injection device, infusion device, and an applicator or plastic syringe.

Embodiment 45. In some further embodiments of embodiment 44, the composition is in a form suitable for introduction by the syringe.

Embodiment 46. In some further embodiments of any one of embodiments 31-45, the animal is selected from the group consisting of a cow, a goat, a sheep, a buffalo, a camel, a donkey, a llama, a horse, a pig, a human, a primate, an avian, a fish, a mule, a cat and a dog Embodiment 47. In some further embodiments of any one of embodiments 1-16, the composition is used in the prevention of bacterial colonization of an animal.

Embodiment 48. In some embodiments, there is provided a method for preventing, treating and reversing bacterial colonization of an animal, comprising administering to the animal a composition according to any one of embodiments 1-12.

Embodiment 49. In some embodiments, there is provided a method of preventing a bacterial colonization in an animal comprising administering to the animal an effective amount of a composition according to any one of embodiments 1-12.

Embodiment 50. In some embodiments, there is provided a method of treating a bacterial colonization in an animal comprising administering to the animal an effective amount of a composition according to any one of embodiments 1-12.

Embodiment 51. In some embodiments, there is provided a method of controlling a bacterial colonization in an animal comprising administering to the animal an effective amount of a composition according to any one of embodiments 1-12.

Embodiment 52. In some further embodiments of any one of embodiments 48-51, the composition has continuous contact with epithelial cells.

Embodiment 53. In some further embodiments of embodiment 35, the epithelial cells are located in an area selected from the group consisting of a mammary gland, a mammary canal, a uterus, an ear canal, an oral cavity, an eye, a sinus and skin.

Embodiment 54. In some further embodiments of any one of embodiments 48-53, the bacteria colonization causes mastitis.

Embodiment 55. In some further embodiments of any one of embodiments 48-54, the animal administered the composition is capable of lactating.

Embodiment 56. In some further embodiments of any one of embodiments 48-55, the animal is at a time period selected from the group consisting of the dry period, the lactating period and the beginning of the dry period at cessation of milking.

Embodiment 57. In some further embodiments of any one of embodiments 54-56, the mastitis resides in a mammary gland.

Embodiment 58. In some further embodiments of any one of embodiments 54-57, the composition is administered to at least one infected mammary gland of the animal.

Embodiment 59. In some further embodiments of any one of embodiments 54-58, the composition is administered to a teat canal of the animal.

Embodiment 60. In some further embodiments of any one of embodiments 54-59, the composition has continuous contact with epithelial cells of the mammary gland.

Embodiment 61. In some further embodiments of any one of embodiments 48-60, the composition is administered by an injection device, infusion device, and an applicator or plastic syringe.

Embodiment 62. In some further embodiments of embodiment 61, the composition is in a form suitable for introduction by the syringe.

Embodiment 63. In some further embodiments of any one of embodiments 48-62, the animal is selected from the group consisting of a cow, a goat, a sheep, a buffalo, a camel, a donkey, a llama, a horse, a pig, a human, a primate, an avian, a fish, a mule, a cat and a dog Embodiment 64. In some further embodiments of any one of embodiments 31-63, the bacteriophage cocktail is administered to an animal before the carrier vehicle.

Embodiment 65. In some further embodiments of any one of embodiments 31-63, the carrier vehicle and bacteriophage cocktail are combined.

Embodiment 66. In some further embodiments of any one of embodiments 31-63, the bacteriophage cocktail is administered simultaneously with the carrier vehicle to an animal.

Embodiment 67. In some further embodiments of embodiment 65, the combination of cocktail and vehicle occurs in vitro.

Embodiment 68. In some further embodiments of embodiment 65, the combination of cocktail and vehicle occurs in vivo.

Embodiment 69. In some further embodiments of any one of embodiments 31-68, the composition is administered at least once at the beginning of the dry period.

Embodiment 70. In some further embodiments of any one of embodiments 31-69, the composition is administered at least once during the dry period.

Embodiment 71. In some further embodiments of any one of embodiments 31-70, the composition is administered at least once during the lactating period.

EXAMPLES

The examples, which are intended to be purely exemplary of the invention and should therefore not be considered to limit the invention in any way, also describe and detail aspects and embodiments of the invention discussed above. The examples are not intended to represent that the experiments below are all or the only experiments performed. Efforts have been made to ensure accuracy with respect to numbers used (for example, amounts, temperature, etc.), but some experimental errors and deviations should be accounted for. Unless indicated otherwise, parts are parts by weight, molecular weight is weight average molecular weight, temperature is in degrees Centigrade, and pressure is at or near atmospheric.

Standard bacteriophage isolation and characterization protocols have been described. See, for example, Carlson K. "Working with bacteriophages: common techniques and methodological approaches. In Working with bacteriophages: common techniques and methodological approaches. CRC Press." 437-494 (2005); Clokie, M. R. J., and A. Kropinski. "Bacteriophages—Methods and Protocols, Volume 2: Molecular and Applied Aspects," 2. Humana Press. 19-20 (2009); Kropinski et al. "The host-range, genomics and proteomics of Escherichia coli O157:H7 bacteriophage rV5." Virol. J. 10:76 (2013); De La Fuente et al. "Small molecules with antimicrobial activity against E. coli and P. aeruginosa identified by high-throughput screening." Br. J. Pharmacol. 149:551-559 (2006).

Standard bioinformatics methods and software for analysis of genomic sequences of the bacteriophages have been described and are available from various sources. See, for example, IDBA (Peng, Y., et al. (2010) IDBA—A Practical Iterative de Bruijn Graph De Novo Assembler. RECOMB. Lisbon) PriceTI version 1.2 (Ruby J G et al. "PRICE: Software for the Targeted Assembly of Components of (Meta) Genomic Sequence Data," G3: Genes/Genomes/Genetics 3.5: 865-880 (2013)); Artemis (Rutherford K, Parkhill J, Crook J, Horsnell T, Rice P, Rajandream M A and Barrell B. Bioinformatics (Oxford, England) 16; 10; 944-5 (2000)); and BLAST+ (Camacho et al. "BLAST+: architecture and applications." BMC bioinformatics 10.1: 1 (2009)).

Example 1: Isolation, Selection and Characterization of Bacteriophages p0031, p0032, p0033, and p0034

Seventy-four bacteriophages were initially isolated using 36 clinical coliform mastitis isolates from dairies in Washington State. Each individual phage preparation was then tested for its ability to suppress growth of the 36 clinical isolates using spot lysis tests. Four distinct, isolated phage strains p0031 (also known as MEV11), p0032 (also known as MEV12), p0033 (also known as MEV21), and p0034 (also known as ME22) were selected from the group of 74 as candidates for an antibacterial composition, based on their distinct broad host ranges against the 36 mastitis strains (Table 3). The isolation and characterization of the four bacteriophages are also described in Porter, et al. J. Dairy Sci. 99:2053-2062 (2016), the contents of which are incorporated herein by reference in their entirety.

Bacterial Strains and Growth Conditions

E. coli collection strains were obtained from the Washington State University College of Veterinary Medicine. The 36 strains (referred hereinafter as "Washington strains") were isolated from cows with clinical coliform mastitis. The Cornell University College of Veterinary Medicine provided a second collection of 26 E. coli strains (referred hereinafter as "New York strains"). The New York strains had been classified as either persistent or transient based on clinical presentation of mastitis. See, Dogan et al. "Adherent and invasive Escherichia coli are associated with persistent bovine mastitis," Vet. Microbiol. 116:270-282 (2006); Dogan et al., "Phylogroup and 1 pfA influence epithelial invasion by mastitis associated Escherichia coli," Vet. Microbiol. 159:163-170 (2012). P4, P5, and P6 were three persistent strains among the New York strains.

All strains were plated on Levine Eosin Methylene Blue agar for confirmation of coliform morphology, maintained as streaks on Tryptic Soy agar (TSA) plates and grown up in Tryptic Soy broth (TSB) in a 37° C. bath shaking at 200 RPM's for the majority of experiments unless otherwise noted.

Bacteriophage Isolation and Characterization

Bacteriophages are found in wastewaters from a variety of sources. Samples of the primary effluent of wastewater from a local sewage treatment plant (Olympia, Wash.) were used to isolate the 74 E. coli bacteriophages using a standard isolation protocol (Carlson, 2005). Briefly, the collected samples were centrifuged for 20 min. at 1,500×g at 4° C. to remove solids. The resulting supernatant was transferred to sterile Erlenmeyer flasks containing a Washington State bacterial culture strain that had reached an exponential growth phase and was grown in 10×TSB. The flasks were incubated with shaking for 18-24 hours at 37° C. Following incubation, chloroform was added to the flasks to kill any remaining viable bacteria. Lysates were centrifuged for 30 min at 3,800×g. The supernatant was filtered through a 0.45 µm PES filter, and 100 µL of the isolated phage lysate was plated with its host Washington State bacterial culture strain using the agar over-lay method (Kropinski 2013). Phage plaques of different morphologies were picked from the agar plate and re-suspended in phage buffer (100 mM NaCl, 100 mM Tris-HCl, 0.01% (w/v) Gelatin). Phage plaque preparations were plated a second time on the same host strain and re-picked to verify isolated phage purity.

Spot lysis tests were used to assess the host range of each isolated bacteriophage preparation. Briefly, 10-20 µL of each bacteriophage preparation was spotted on lawns of each of the 36 Washington state mastitis host strains using the agar overlay method (Kropinski 2013). Plates were examined and scored for degree of bacterial clearance. Preparations with the highest degree of clearance on the most strains were selected for the coliform cocktail and subsequently amplified (Carlson 2005).

Four bacteriophages that could clear at least 25% of the Washington mastitis bacterial strains were selected, aiming to have at least one of the selected bacteriophages to clear each of the Washington mastitis bacterial strains. Table 3 lists the selected bacteriophage isolates and the number of mastitis host strains cleared by each of the four phages for the bacteriophage coliform cocktail.

TABLE 3

| Phage Isolate | Bacteriophage Designation | Bacteriophage Identification | Percentage Washington Strains cleared (No.) |
|---|---|---|---|
| 1 | p0031 (MEV11) | T4-like phage | 37% (13) |
| 2 | p0032 (MEV12) | Schizo-T4-like phage | 27% (9-10) |
| 3 | p0033 (MEV21) | rV5-related and phi92-related phage | 43% (15) |
| 4 | p0034 (ME22) | rV5-related and phi92-related phage | 31% (11) |

Bacteriophage Identification, E. coli Phages

Using standard methods, pulsed-field gel electrophoresis was used to determine whether each phage preparation contained multiple or single phages. Restriction fragment length polymorphism analysis was performed on extracted phage DNA using EcoRV (EC:3.1.21.4) to determine whether each phage in the cocktail was distinct (Clokie and Kropinski 2009).

Genome sizes of these phages were estimated to be between 140 and 172 kilobases following analysis by pulsed field gel electrophoresis. Three of the four phage genomes were susceptible to digestion under standard conditions by EcoRV. The banding patterns of the genomic fragments were dissimilar. Together, these results demonstrate that each of the four isolated phage preparations contain a single, isolated bacteriophage genetically distinct and so different from each of the others.

Phage genomes were sequenced using Illumina® HiSeq 2000 with 200× coverage. Reads were assembled using idba version 1.1.1 (Peng et al. 2010) followed by PriceTI version 1.2 (Ruby J G 2013) and then annotated using Artemis (Rutherford 2000) and percent identities were compared to the NCBI database using BLAST+. Table 4 below lists the BLAST results of each bacteriophage.

TABLE 4

| Isolate | Genome Size (bps) | Taxonomic Family | Closest Taxonomic Relative * | BLAST Results | | | | |
|---|---|---|---|---|---|---|---|---|
| | | | | Max. Score | Total Score | Query cover | E | Identity |
| p0031 (MEV11) | 170,151 | Myoviridae T4-like | LN881737.1 | 94038 | 2.59E+05 | 93% | 0 | 97% |
| p0032 (MEV12) | 167,434 | Myoviridae T4-like | EF437941.1 | 62377 | 2.65E+05 | 96% | 0 | 97% |
| p0033 (MEV21) | 149.657 | Myoviridae | KU522583.1 | 62292 | 2.38E+05 | 95% | 0 | 97% |
| p0034 (ME22) | 149,242 | Myoviridae | KU522583.1 | 1.29E+05 | 2.37E+05 | 95% | 0 | 97% |

* NCBI accession numbers of the closes taxonomic relatives are listed.

The distinctness of each of the four selected, isolated phages (p0031, p0032, p0033, and p0034) was confirmed by genome sequence analysis, and they were identified as T4-like phage, Schizo-T4-like phage, rV5 and phi92-related phage, and rV5 and phi92-related phage respectively (Table 3). Bacteriophage rV5 has been described in .e.g., Kropinski 2013. Bacteriophage phi92 is known for its broad host range due to its multivalent adsorption apparatus. See, for example, Schwarzer et al. J. Virol. 86:10384-10398 (2012). All four of the bacteriophages are lytic and do not contain genes that would suggest prophage-like capabilities.

Example 2: Effect of Bacteriophage Cocktail on Growth of E. coli Isolates

A bacteriophage cocktail comprising p0031, p0032, p0033 and p0034 was prepared. The efficacy of the bacteriophage cocktail in inhibiting growth of the Washington State and New York bacterial strains were assessed.

Optical Density Growth Curves

The effects of different doses of bacteriophage cocktail on the growth of E. coli were assessed. Optical density growth curves were generated for each bacterial strain by measuring E. coli growth density at 570 nm ($OD_{570}$) at 30-minute intervals. A culture of each clinical E. coli strain was grown to an $OD_{570}$ of 0.3 (roughly 1×10$^8$ CFU/mL) in TSB. The culture was diluted in TSB to roughly 1×10$^6$ CFU/mL and an aliquot of 0.18 mL for each strain was added to individual wells in a 96-well plate previously treated with 0.02 mL of phage at concentrations that achieved a multiplicity of infection (MOI) of 10, 100, and 1000. A positive control of 10 and 1 µg/mL of the antibiotic ceftiofur were also used. The $OD_{570}$ was measured every 30 minutes for 12 hours. All tests were done in triplicate and repeated twice.

Percent inhibition was calculated for each strain treated with the bacteriophage cocktail based on the measured optical density values at 12 hours. Percent inhibition was calculated as $(OD_{negative\ control} - OD_{treatment})/(OD_{negative\ control} - OD_{positive\ control}) \times 100$ (De La Fuente et al. 2006). In the calculation, the positive control refers to bacteria cultures treated with ceftiofur at 10 µg/mL, the negative control refers to bacterial cultures without bacteriophage or ceftiofur treatment, and the "treatment" refers to bacterial cultures treated with the bacteriophage cocktail at 100 MOI.

Each bacterial strain was categorized based on the percentage growth inhibition of the bacterial strain by the bacteriophage cocktail observed at 12 hours. The categories are: (a) completion inhibition (91-100% inhibition in growth), (b) partial inhibition (between 10% and 90% inhibition in growth); and no inhibition (0%-9% decrease in growth).

Growth curves for bacterial strains within each category were averaged together to generate a mean growth curve, as shown in FIGS. 2A-2D. A student's t-test was performed on the last time point of each mean curve.

To analyze the effect of the different bacteriophage MOI on the growth curve of 62 E. coli isolates, a general linear model (repeated-measures analysis of covariance) was used. The dependent variable was the OD570 of the TSB culture; the fixed effects included treatment (different phage concentrations and controls) and time. The interaction of treatment and time was also included in the model. Our data were longitudinally collected and, therefore, had a series of repeated measures (total of 24) of optical density throughout the study period. To account for within-E. coli correlation of the optical density, the error term was modeled by imposing a first-order autoregressive (AR-1) covariance structure. All statistical tests were run in JMP Pro (11.0, SAS Institute Inc., Cary, N.C.) with an $\alpha=0.05$.

Results

Figure 1A:
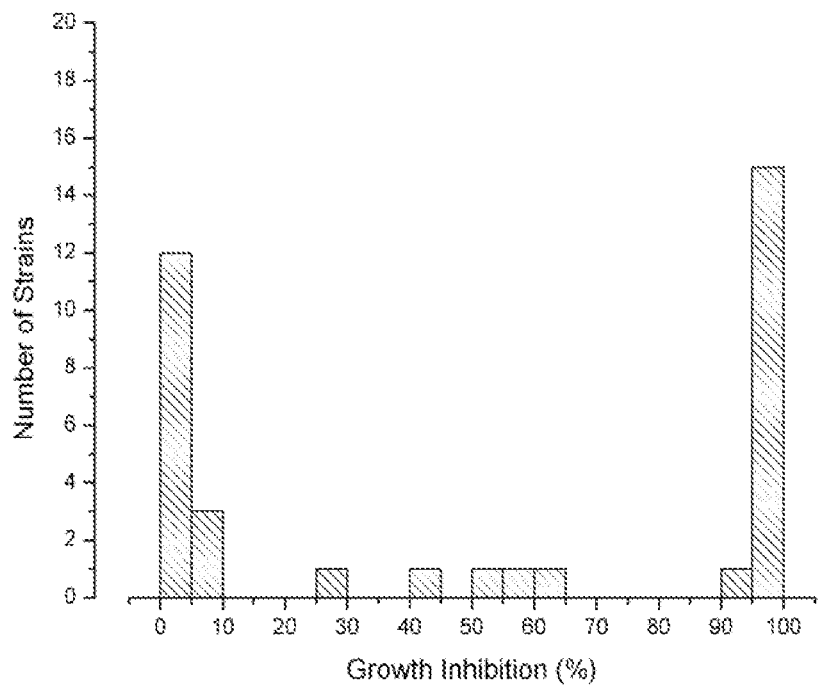
FIGS. 1A-1B illustrate growth inhibition of bacterial isolates by a four-bacteriophage cocktail.
Figure 1B:
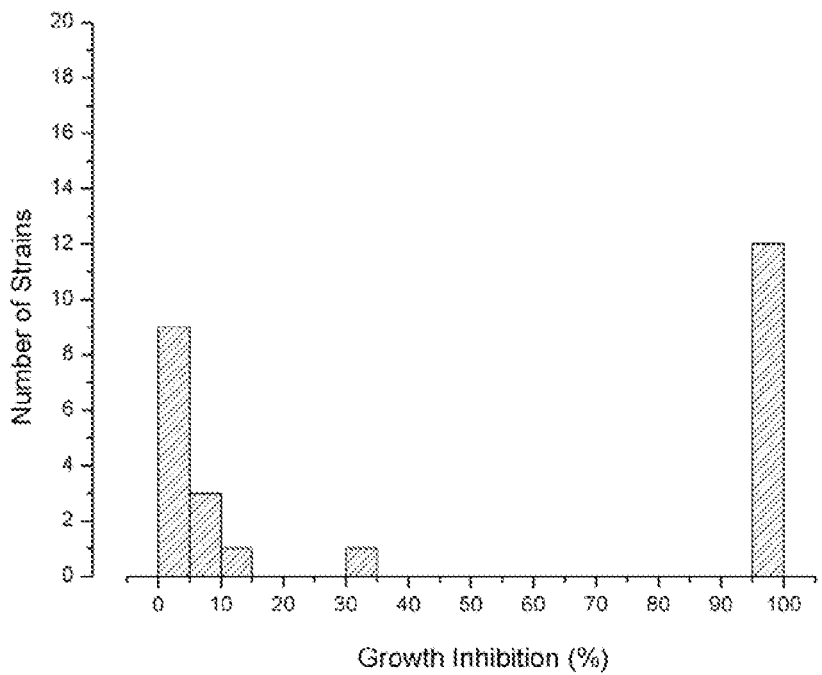

Different doses of the bacteriophage cocktail (MOI) were used to measure its ability to suppress growth of the 36 Washington State E. coli clinical strains. The phage cocktail demonstrated a broad spectrum of action against these isolates. As seen from Table 3, each of the four bacteriophages individually can only inhibit 27-43% of the Gram (−) Washington E. coli strains evaluated. However, twenty-one of the 36 Washington State strains (58%) were completely or partially inhibited by the phage cocktail at a MOI of 100 (FIG. 1A). In order to assess the applicability of the cocktail to kill field E. coli strains different from the strains used to isolate the phages, the same growth curve inhibition analysis was performed on the collection of 26 clinical coliform mastitis strains from New York State. The phage cocktail showed a similar distribution of growth inhibition as compared to the Washington State strains; fourteen of the 26 strains (54%) showed complete or partial inhibition (FIG. 1B). Complete inhibition was defined as greater than ninety percent reduction of bacterial growth by the phage cocktail at twelve hours, as compared to controls. Partial inhibition was defined as between ten and ninety percent reduction in growth, while no inhibition was categorized as less than a ten percent growth suppression of bacteria.

Figure 2A:
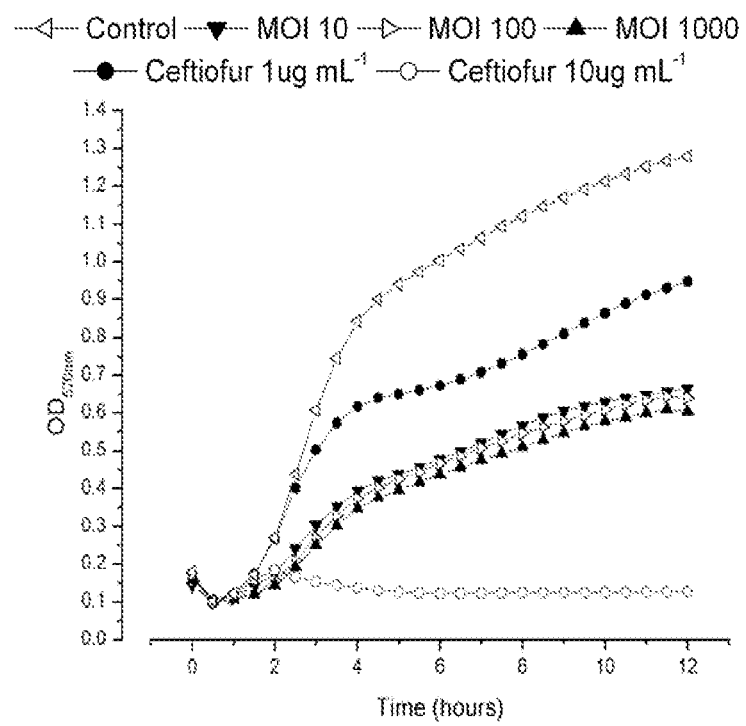
FIGS. 2A-2D illustrate mean optical density growth curves (OD570 nm) for *E. coli* isolates from mastitis cows from two different states (Washington or New York). The bacterial isolates were inoculated with a 4-bacteriophage cocktail at different multiplicities of infection (MOI), different concentrations of ceftiofur (positive control), and in the absence of bacteriophage or ceftiofur (negative control).
Figure 2B:
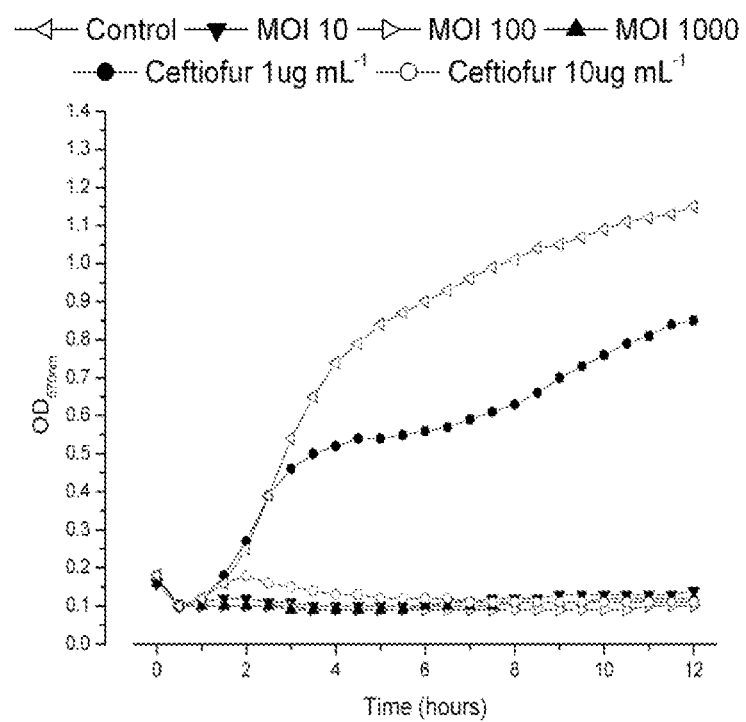
Figure 2C:
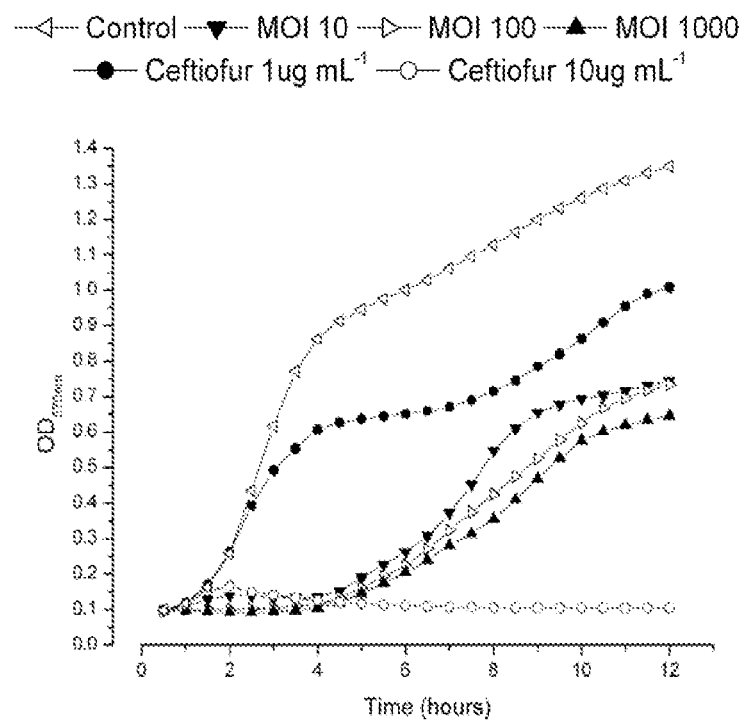

FIGS. 2A-2D illustrate the mean growth curves of the various categories of the 62 bacterial strains treated with the bacteriophage cocktail at different doses (i.e., MOIs). FIG. 2A shows the mean growth curves of all 62 bacterial strains. FIG. 2B shows the mean growth curves of 28 bacterial strains that were completely inhibited by the bacteriophage cocktail. FIG. 2C shows the mean growth curves of 7 bacterial strains that were partially inhibited by the bacteriophage cocktail. FIG. 2C shows the mean growth curves of 27 bacterial strains that were not inhibited by the bacteriophage cocktail. For all of the *E. coli* strains tested, growth curves were not significantly affected by dose, demonstrating that each of the multiplicities of infection tested was about equally effective in inhibiting bacterial growth. In contrast, all bacterial strains were completely susceptible to ceftiofur at a dose of 10 µg/mL, but their growth was only partially inhibited by ceftiofur at a dose of 1 µg/mL (FIGS. 2A-2D).

Figure 2D:
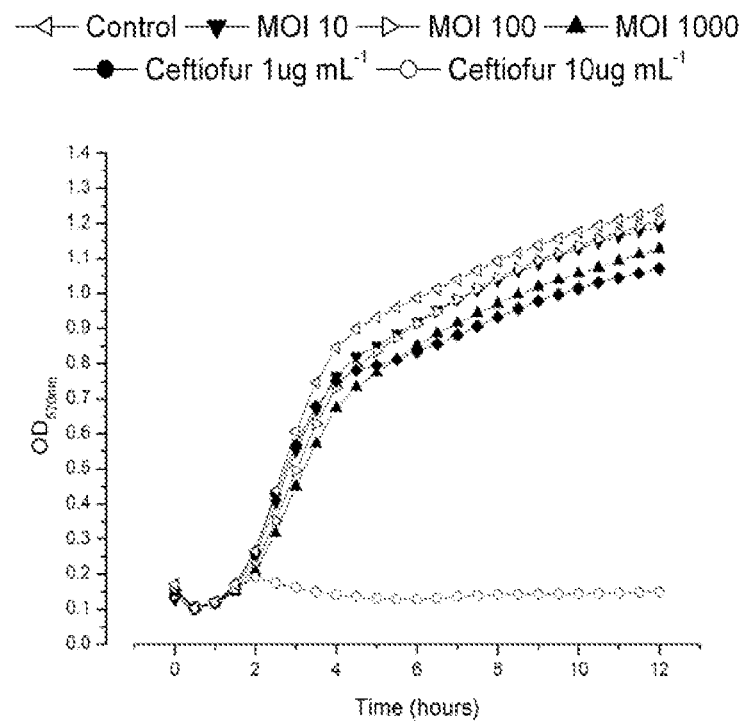

The 95% CI represent the average OD over the entire experimental period. For the control, 95% CI=0.875-0.833; for ceftiofur 1 µg/mL, 95% CI=0.833-0.875; and for ceftiofur 10 µg/mL, 95% CI=0.129-0.137. For all bacteriophage doses, 95% CI=0.104-0.110 for strains completely inhibited (FIG. 2B), 0.300-0.355 for strains partially inhibited (FIG. 2C), and 0.746-0.782 for strains with no inhibition (FIG. 2D). P-values between treatment and controls in the complete inhibition or partial inhibition categories were <0.05, demonstrating statistically significant difference in bacterial growth under these conditions.

Example 3: Effect of Bacteriophage Cocktail on Growth of Bacteria in Raw Milk

Raw milk was collected from quarters of healthy cows on a dairy in Washington State. Milk was initially examined for inflammatory cells, and then plated on TSA plates to test for native bacteria. Only milk samples negative on a California Mastitis Test (W. H. Whiteside Canadian Public Health Journal (1939) 30:44, and Schalm O W & Noorlander D O. Journal of the American Veterinary Medical Association (1957) 130:199-204) and containing less than 100 colony forming units (CFU) per mL were used.

In order to distinguish the inoculant bacteria in raw milk from background coliforms, a persistent *E. coli* strain P5 from the New York bacterial strains was transformed with a pUC-18 plasmid containing Amp-R (ampicillin resistance) to provide the "P5-AmpR" strain. 100 µL of different dilutions of an overnight broth culture of strain P5-AmpR was added to 10 mL of raw milk for treatment and control groups. Treatment flasks contained 100 µL of a $1 \times 10^9$ plaque forming units (PFU) PFU/mL of a 4-phage cocktail (p0031, p0032, p0033, and p0034), while control flasks contained the same volume of phage buffer. Flasks were incubated at 37° C. for 12 hours with shaking. At the end of 12 hours, samples were plated on TSA plates containing 100 µg/mL of ampicillin. Surviving bacterial colonies and phage plaques were enumerated following overnight incubation. All tests were done in triplicate and repeated twice. A student's t-test was performed to assess differences between groups for both experiments. A 3.3 to 5.6 log reduction in bacterial growth compared to the control was achieved when the cocktail was challenged with $10^2$, $10^3$, $10^4$, $10^5$ and $10^6$ CFU/ml (P<0.05).

Figure 3:
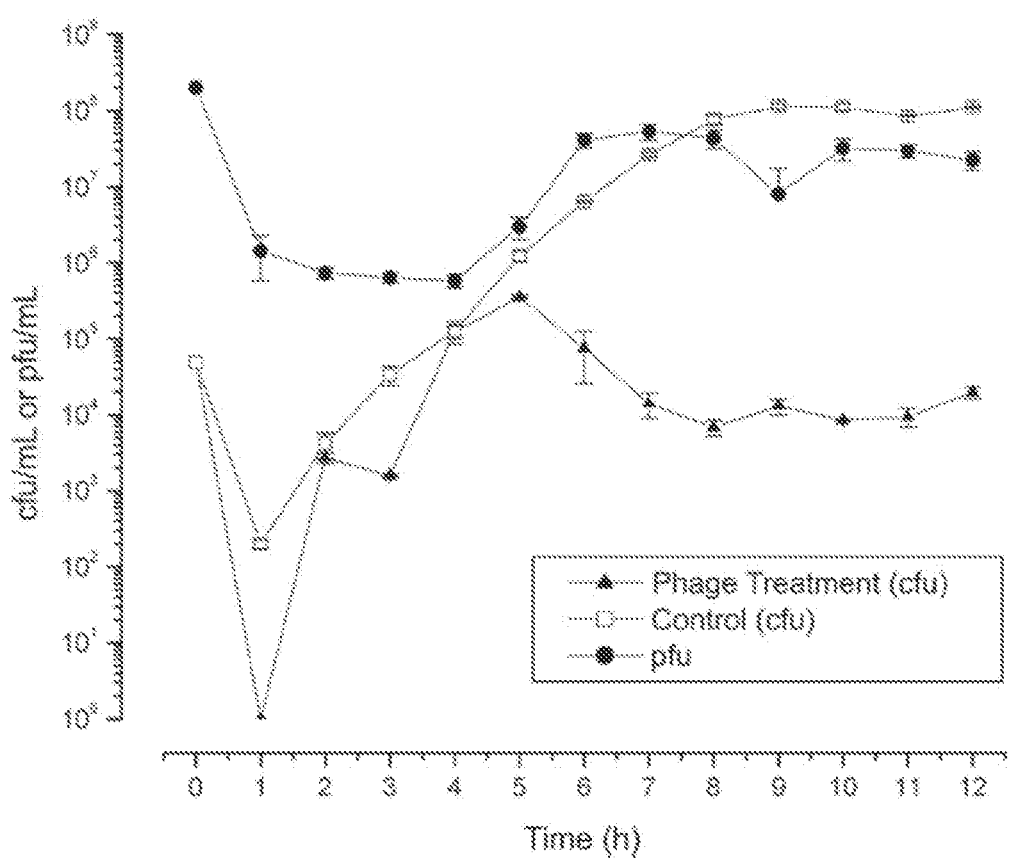
FIG. 3 shows a growth curve of persistent *E. coli* strain P5-AmpR inoculated with a 4-bacteriophage cocktail or phage buffer (control) in raw milk.

A 12-hour bacterial growth curve with or without the 4-phage cocktail in raw milk was also determined. Bacteriophage titers were measured in order to assess phage binding and replication in raw milk. A 3.75 log reduction in bacterial growth at 12 hours was achieved (P<0.05). Decreases in CFU counts corresponded with increases in PFU counts indicating phage lysis of bacteria between four and eight hours. Results are illustrated in FIG. 3.

Example 4: Effect of Bacteriophage Cocktail on Adhesion and Invasion of *E. coli* to Mammary Epithelial Cells To examine whether the 4-bacteriophage cocktail (p0031, p0032, p0033, and p0034), could prevent and clear chronic coliform infections, a tissue culture assay was performed as an ex vivo model to study the effects of the bacteriophage cocktail on the ability of *E. coli* to adhere and invade mammary epithelial cells.

Adhesion and invasion assays were conducted using an immortalized bovine mammary alveolar epithelial cell line, MAC-T. See, Huynh et al., Exp. Cell Res. 197:191-199 (1991). MAC-T monolayers were incubated at 37° C. with 5% $CO_2$, 95% air (v/v) using Dulbecco's Modified Eagle Medium (DMEM)/Nutrient Mixture F-12 supplemented with 5% fetal bovine serum (v/v).

To quantify the total cell-associated bacteria (intracellular bacteria plus surface-adherent bacteria), a standard adhesion assay was performed according to Döpfer et al., Vet. Microbiol. 74:331-343 (2000). Confluent MAC-T monolayers were grown in 12-well tissue culture dishes to an average concentration of $4 \times 10^5$ cells/well. An overnight culture of clinical persistent *E. coli* strains P4, P5, and P6 were pelleted and washed 3 times with phosphate-buffered saline (PBS) and re-suspended in DMEM with enough volume to obtain an $OD_{570}$ of 1.0 (Dogan et al., 2006; 2012). Cultured cells were infected using approximately 10 bacteria cells per MAC-T cell. The 4-phage cocktail was then added to treatment wells at an MOI of about 100. Controls included infected cells without phage treatment and cells treated with phage but without bacterial infection. After 1 hour of incubation, DMEM was removed and wells were washed 6 times with PBS to remove non-adherent extracellular bacteria and phage. 1 mL of lysis buffer (0.1% (w/v) Triton X-100 and 0.025% trypsin) was added to each well and incubated for ten minutes at 37° C. Lysates were serially diluted and plated on TSA plates, incubated at 37° C. overnight and cell-associated bacteria were quantitated using standard enumeration methods known in the art.

An invasion assay was performed as described in the adhesion assay with modifications. After one hour of incubation at 37° C., DMEM was removed and replaced with 100 µg/mL of gentamicin-laden DMEM to kill remaining extracellular *E. coli*. Tissue culture dishes were incubated for an additional hour at 37° C. and wells were treated as described in the adhesion assay.

Figure 4A:
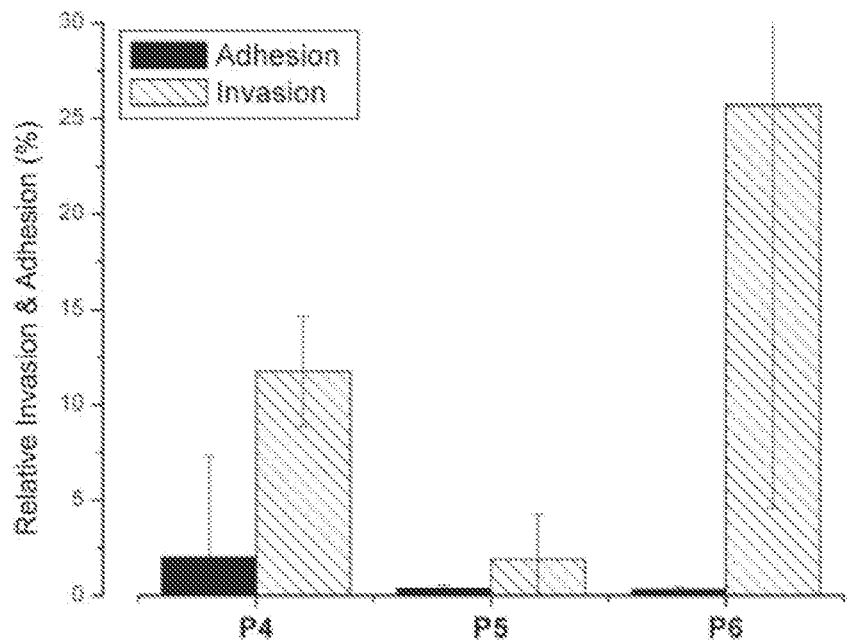
FIGS. 4A-4B illustrate effect of a 4-bacteriophage cocktail on an in vitro model of chronic coliform infection.

Tissue culture plates pre-treated with approximately $10^8$ PFU of the bacteriophage cocktail resulted in reduced adhesion and invasion to mammary epithelial cells by three different chronic mastitis *E. coli* strains (P4, P5, and P6). In particular, adhesion was reduced by 98.0 (P=0.107), 99.6, and 99.7 (P<0.05) percent for P4, P5, and P6, respectively (FIG. 4A). Intracellular invasion into mammary epithelial cells, as measured by the gentamicin protection assay, was also reduced for the three strains P4, P5, and P6 by 88.3, 98.1, and 74.3 percent (P<0.05) respectively in the presence of the bacteriophage cocktail (FIG. 4A).

To assess the ability of intracellular phage to inhibit internalized bacteria and to replicate inside the bacteria following co-internalization in the mammary epithelial cells, a long-term invasion assay was performed over the course of 3 days. Both intracellular bacteria and phages were counted throughout the course of the experiment. The standard invasion assay was modified by further incubation at 37° C. of P4 infected MAC-T monolayers for up to 72 hours with 100 µg/mL of gentamicin-laden DMEM. At 2, 24, 48, and 72 hours, the number of intracellular bacteria and phages were enumerated. All cell culture assays were performed in duplicate and a Student's t-test was performed to assess differences between groups.

Figure 4B:
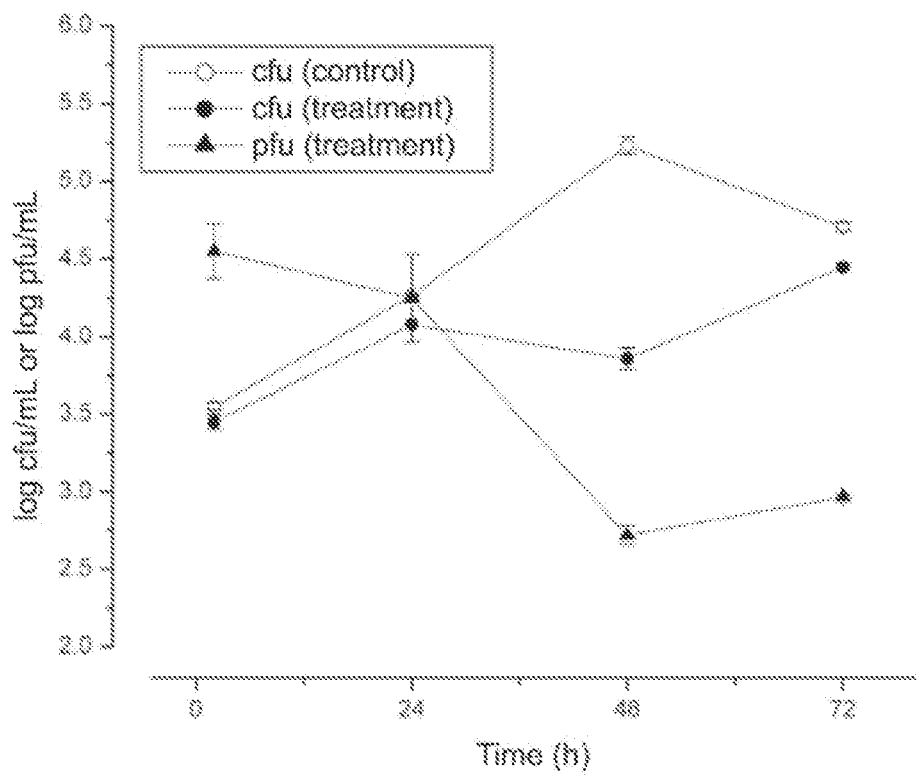

Although incubation with gentamicin resulted in no significant difference in intracellular bacteria counts after 48 and 72 hours, the bacteriophage PFU counts were relatively stable throughout the assay and appeared to increase in response to bacterial growth (FIG. 4B). When comparing intracellular bacterial counts to negative controls (no bacteriophage cocktail), P-values for each time point were <0.05. Without being bound by any theory or hypothesis, a cycling in the number of bacteriophages might occur in response to the growth and decline in the intracellular persistent bacteria.

Example 5: In Vitro Effect of Bacteriophage Cocktail with a Bismuth-Based Teat Sealant Delivery Vehicle on Growth of E. coli The 4-bacteriophage cocktail (p0031, p0032, p0033, and p0034) was mixed with a common teat sealant ointment containing bismuth subnitrate (ORBESEAL® paste, Zoetis, Florham Park, N.J.) to provide a paste suitable for delivery of the bacteriophage cocktail within teat canals. The paste was an emulsification formed by combining together: 2 grams of the sealant ointment, 500 µL of Tween 80 (Sigma-Aldrich) and 1 mL of $1\times10^9$ PFU/mL bacteriophage cocktail diluted in phage buffer.

The in vitro antibacterial activity of the bacteriophage cocktail paste was tested in a liquid growth medium. 10 mL of TSB containing 1 or 0.6 grams of the phage paste were inoculated with $1.6\times10^3$ CFU/mL of clinical mastitis bacteria P5 in a 50 mL falcon tube. Paste with only phage buffer (absent bacteriophage cocktail) was used as a control. All tubes were incubated at 37° C. with shaking for the duration of the experiment. Tubes were sampled at 0, 4, 8, and 12 hours, serially diluted and plated on TSA using standard techniques.

Figure 5:
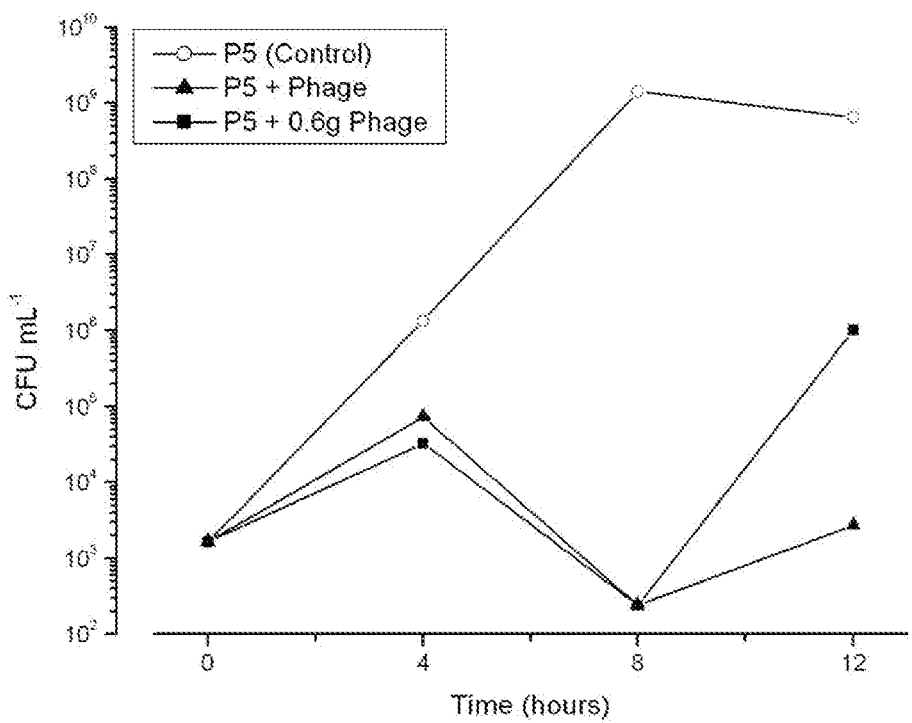
FIG. 5 depicts a growth curve of strain P5 in Tryptic Soy Broth (TSB) with two different concentrations of bacteriophage cocktail formulated in teat sealant emulsions as compared to the control.

The bacteriophage paste at $10^9$ and $6\times10^8$ PFU was able to reduce bacterial growth by 5.40 and 2.80 logs respectively after twelve hours of incubation at physiologic temperature (FIG. 5). The greatest difference between the treatment and control groups occurred at the 8 hour time point, resulting in a 6.77 log reduction in bacterial counts. MOI can be determined by dividing the phage PFU by the initial bacteria CFU. In the above example, the two effective doses of the bacteriophage paste corresponded to $6.25\times10^6$ MOI (i.e., $1.0\times10^9$ PFU/$1.6\times10^3$ CFU/mL) and $3.75\times10^5$ (i.e., $6\times10^8$ PFU/$1.6\times10^3$ CFU/mL) MOI respectively.

Example 6: Inhibition of E. coli by a Bacteriophage Cocktail with a Bismuth-Based Teat Sealant Delivery Vehicle To test a potential delivery system for bacteriophage cocktail within teat canals, an emulsification of a bacteriophage cocktail and a common teat sealant (e.g., see the composition in Example 5) are administered to a mastitis infected teat and a non-mastitis teat of the same cow following sterile techniques:
1. Syringes containing a composition comprising the bacteriophage cocktail and teat sealant as a delivery vehicle are stored at room temperature for ease of dispensing the paste into the teat.
2. Cow udder and teats are dried abruptly rather than gradually.
3. Teat ends are cleaned as thoroughly as possible with alcohol and allowed to air dry. Care is taken to not use water without disinfectant.
4. The two teats furthest away are cleaned first, followed by the two closest.
5. The teats are clean and dry before infusing the composition of bacteriophage cocktails and teat seal paste.
6. The teats are infused in the opposite order to cleansing; the closest two teats are infused first followed by the two furthest away.
7. Following infusion, the teats are dipped in teat dip or sprayed with disinfectant and the cow is allowed to stand for at least an hour to allow the streak canal to close.
8. The cow is monitored regularly for signs of mastitis during the first weeks after drying off.

Example 7: Effect of Bacteriophage Cocktail on Bacteriophage Insensitive Mutants When bacteria are treated with a bacteriophage at a low MOI, bacteriophage insensitive mutants (BIM) can emerge after a long period of incubation, eventually rendering the bacteria culture resistant to the bacteriophage treatment. Without being bound by any theory or hypothesis, BIM can account for resistance to bacteriophage-based treatments, especially for treatment of chronic diseases or conditions, such as chronic mastitis.

Figure 6:
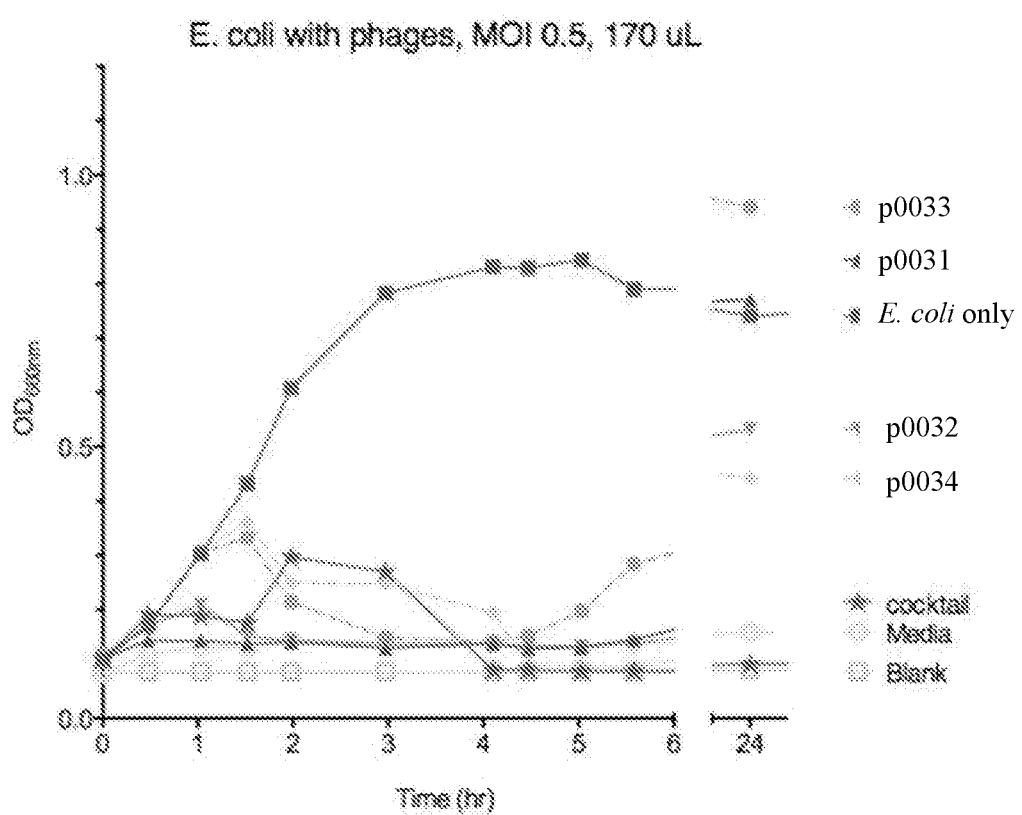
FIG. 6 shows growth curves of *E. coli* b00ca in liquid medium treated with individual bacteriophages p0031, p0032, p0033, p0034 or a 4-bacteriophage cocktail at low MOI over a period of 24 hours. Control conditions include untreated *E. coli* (*E. coli* only), blank, or medium only.

FIG. 6 shows optical density curves of an E. coli culture (a clinical isolate of bovine mastitis, ECC-1470, internally barcoded as b00ca) treated with individual bacteriophages p0031, p0032, p0033, p0034, or a cocktail consisting of the four bacteriophages at an MOI of 0.5. BIM emerged in all four cultures treated with individual bacteriophages at 24 hours of incubation, leading to a high $OD_{660\ nm}$ comparable to non-treatment control. In particular, BIM emerged in a culture treated with p0033 as early as 6 hours. In contrast, the 4-bacteriophage cocktail was effective in preventing the emergence of any BIMs over the 24 hour treatment period. These results suggest that the 4-bacteriophage cocktail is more effective than individual bacteriophages in treating bacterial infections and preventing resistance over a long term.

Example 8: Isolation of Bacteriophage p0045 Against BIM

E. coli were generated to be resistant to a selection of bacteriophages, and a mix of these resistant hosts were used to isolate bacteriophages from environmental samples by performing a two-step enrichment of the sample before spotting the sample onto a lawn of a resistant isolate and plucking the resultant plaque.
1. Generation of Bacteriophage Insensitive Mutants (BIMs)
The parent bacterial host b00ca was treated with a bacteriophage cocktail consisting of bacteriophages p0031, p0032, p0033, and p0034 in equivalent ratios in tryptic soy broth (TSB) as follows. After 24 hours of growth with shaking at 250 rpm at 37° C., cultures were streaked out onto tryptic soy agar (TSA) plates to isolate colony forming units (CFU) and grown at 37° C. Then, 2 colonies (BIMs) per sample were picked and resuspended in TSB. Three of these BIMs from separate experiments on different dates were selected for further testing.

Starting conditions for generating the three BIMs used for phage isolation in this example were as follows: BIM r0037 was generated from starting concentrations of $4\times10^7$ CFU/mL of b00ca bacteria and $2\times10^7$ cumulative plaque forming units (PFU)/mL of the bacteriophage cocktail in 170 µL TSB. BIMs r003h and r003j were generated from starting concentrations of $1\times10^5$ CFU/mL of b00ca bacteria and about $1\times10^7$ cumulative PFU/mL of the bacteriophage cocktail in 2000 µL TSB.

The BIM isolates were confirmed to be the same strain as the parent host by PCR using primers generated against the parent strain genomic sequence. Resistance of the isolates to the bacteriophage cocktail was confirmed by optical density assays with the bacteriophage cocktail as well as spotting individual phages onto a lawn of each isolate.

2. Enrichment of Environmental Sample Using BIMs

A. First enrichment: The three aforementioned BIMs were grown to mid-log phase (optical density $OD_{660\ nm}$ of 0.3-0.5) in TSB and added in equal concentrations for a total starting concentration of 0.05 CFU/mL in 1 mL of 2× lysogeny broth (LB) and 1 mL of a sewage effluent environmental sample collected from Silicon Valley Clean Water (SVCW) that had been filtered using a 0.22 μm filter.

B. Second enrichment: After 15 hours of growth at 250 rpm at 37° C., the sample was spun down at 3100 g for 10 minutes at room temperature, and the supernatant was transferred to a fresh tube. 400 μL of this 1× enriched environmental sample was added to a fresh mid-log culture of the three BIMs at a total starting concentration of $2 \times 10^7$ CFU/mL in 2 mL TSB.

C. Spotting for plaque formation: After 15 hours of growth at 250 rpm at 37° C., the twice-enriched sample was spun down at 3100 g for 10 minutes at room temperature. 5 μL of the supernatant was spotted onto lawns of each BIM (r0037, r003h, and r003j) using the double agar overlay method.

After incubation of the plate at 37° C. for 15 hours, clear plaques were observed on all lawns and were subsequently plucked and resuspended in 500 μL phage buffer. The plucked bacteriophages were plaque purified, and amplified using conventional phage propagation methods, and the bacteriophage initially plucked from the r0037 lawn (named "p0045") yielded the highest titers and was thus used for further experiments.

3. Identification of p0045

Bacteriophage p0045 is sequenced using Illumina® HiSeq 2000 with 200× coverage. Its genome sequence of is assembled, and analyzed using NCBI BLAST+ as described in Example 1.

4. Effect of p0045 on Growth of *E. coli* Strains

P0045 was tested against a range of *E. coli* strains from various sources in a spot lysis assay. As shown in Table 5 below, p0045 was able to lyse a number of strains. ECC1470 and ECCZ are persistent mastitis *E. coli* strains.

Example 9: Effects of a Mixed Bacteriophage Cocktail Against Both Gram (−) and Gram (+) Bacterial Agents of Mastitis Isolation and Identification of a Bacteriophage Against a Gram-Positive Bacterium Bacteriophages against Gram (+) bacteria are also found in wastewaters from a variety of sources. A bacteriophage to *Staphylococcus aureus* was isolated from the primary sewage water discharge obtained from the sewage treatment plant located about 3 Km from the center of the city of Shkodër (Albania) using the standard isolation protocol. 50 ml from each of the collected 500 ml samples were centrifuged for 20 min. at 1,500×g at 4° C. to remove solids. The resulting supernatant was transferred to a sterile Erlenmeyer flask. To enrich phage numbers, added to the sterile flask was 100 ml of double strength nutrient broth (16 g dehydrated nutrient broth/liter of sterile water) plus 2 ml of the bacterial culture strain *S. aureus* that had reached an exponential growth phase. The *S. aureus* strain was isolated by a laboratory technician in a nearby clinic from a patient's infected finger. The flasks were incubated with shaking for 18-24 hours at 37° C. Following incubation, the enriched medium with bacteriophage and *S. aureus* was centrifuged for 30 min at 3,800×g. The supernatant was then filter sterilized through a 0.45 μm PES filter to remove any bacteria, and 100 μL of the phage supernatant was plated with its host *S. aureus* bacterial culture strain using the double agar over-lay method to visualize phage plaques. Phage plaques of different morphologies were picked from the agar plate and re-suspended in phage buffer (100 mM NaCl, 100 mM Tris-HCl, 0.01% (w/v) Gelatin). Phage plaque preparations were plated a second time on the same host strain and re-picked to verify isolated phage purity.

Spot lysis tests were used to assess the host range of each isolated bacteriophage preparation. Briefly, 10-20 μL of each bacteriophage preparation was spotted on lawns of USA mastitis strains of *S. aureus* using the agar overlay method. Plates were examined and scored for degree of bacterial clearance. A preparation labeled as "Stab8" bacteriophage (also known as p0014) was found to have activity on approximately 80% of the USA mastitis strains of *S. aureus*. Bacteriophage activity was predicated on the phage being able to inhibit growth from about 10%-90% for each of the USA mastitis *S. aureus* bacterial strains.

The isolated bacteriophage p0014 was sequenced using Illumina® HiSeq 2000 with 200× coverage. Its genome sequence of was assembled, and analyzed using NCBI BLAST+ as described in Example 1. P0014 was identified

TABLE 5

| | Bacteria clinical isolates | | | | |
|---|---|---|---|---|---|
| | ATCC43894 | ATCC931749 | ATCC931160 | ATCC930702 | ECC1470 |
| Barcode p0045 | b000c0 | b000z0 | b00103 | b00110 | b00ca5 |

| | Bacteria | | | | | | |
|---|---|---|---|---|---|---|---|
| | clinical isolates | | | | lab strains | | |
| | ECC-Z | BIM | BIM | BIM | ZK126 | BL21 | lab strain | ETEC |
| Barcode p0045 | b00cz0 | r00375 | r003h5 | r003j5 | b010h5 | b000p5 | b00cx5 | b00cq0 | as a Myoviridae phage effective against a human clinical isolate determined to be *S. aureus*. Table 6 shows the BLAST results of the genome sequence of p0014 against its closest taxonomic relative.

TABLE 6

| Isolate | Genome Size (bps) | Taxonomic Family | Closest Taxonomic Relative * | BLAST Results | | | | |
|---|---|---|---|---|---|---|---|---|
| | | | | Max. Score | Total Score | Query cover | E | Identity |
| p0014 (Stab8) | 140,255 | Myoviridae | KM216423.1 | 1.37E+05 | 2.31E+05 | 93% | 0 | 99% |

Effects of Bacteriophage Cocktail on Growth of Mastitis Bacterial Strains

A bacteriophage cocktail comprising four bacteriophages targeting Gram (−) bacteria (such as p0031, p0032, p0033, and p0034) and the bacteriophage targeting a Gram (+) bacterium (such as p0014) is prepared. Different doses of the bacteriophage cocktail (MOI) can be used to measure its ability to suppress growth of both Gram (−) and Gram (+) bacterial strains of clinical mastitis. Growth curves are measured for each bacterial strain treated with the bacteriophage cocktail or control conditions as described in Example 2. The phage cocktail may demonstrate a broad spectrum of action against these isolates. For example, a number of Gram (−) and Gram (+) bacterial strains may be completely or partially inhibited by the bacteriophage cocktail at a MOI of 100, including bacterial strains from geographically distant regions, similar to the results in FIGS. 1A-1B.

Example 10: Bovine Mastitis Proof of Concept Field Studies

Field studies (Phase I and Phase II) of a bacteriophage composition comprising five bacteriophages p0031, p0032, p0033, p0034 and p0045 were carried out on dairy cows inoculated with persistent mastitis *E. coli* ECC1470 in order to obtain information on the efficacy and safety of the bacteriophage composition.

Holstein cows at 30-90 days in milk (DIM) were studied. Half of the cows were primiparous, and the other half of the cows were multiparous. Cows used in the preliminary phage safety study of Phase I had any parity, age, or DIM. Inclusion criteria required that the cows had no more than 200 k somatic cell count (SCC) in milk at the last Dairy Herd Improvement Association (DHIA) test, and the cows were systemically healthy. Exclusion criteria included: (1) more than one case of clinical mastitis in current lactation. Strong preference was given for cows with zero case of clinical mastitis; (2) major pathogens detected by culture at the farm at the time of enrollment, including *Streptococcus agalactiae*, environmental strep *Streptococcus*, *Staphylococcus aureus*, *Pseudomonas*, *Mycoplasma*, *E. coli*, *Prototheca*, and yeast; (3) detection of any bacterial growth in inoculated quarter of udder on the day prior to inoculation; (4) SCC greater than or equal to 200K in inoculated quarter on the day prior to inoculation; and (5) history of J5 or other endotoxin vaccine.

Phase I Study

In Phase I of the study, 4 cows ("bacteria inoculation group") were inoculated with a persistent *E. coli* strain ECC1470 in one mammary quarter each at a dose of 100 CFU to confirm successful bacterial inoculation in the cow's udders. 2 cows ("phage safety group"), which were not inoculated with *E. coli*, had one mammary quarter infused with 10 mL of the bacteriophage composition at about $10^9$ PFU/mL to obtain preliminary safety data on the bacteriophage composition. One of the two cows had a second bacteriophage intramammary infusion 24 hours after the first infusion. The cows were allowed to adapt for 5-7 days before inoculation with the bacteria or the bacteriophage composition. Cows in the bacteria inoculation and phage safety groups were monitored for 7 days after the bacterial inoculation or bacteriophage infusion at t=0. Monitored parameters included TPR (temperature, pulse, and respiration), attitude score, udder score, milk score, milk yield, complete blood cell count with differential, Somatic Cell Count (SCC) and CFU in milk. Clinical endpoints included TPR, udder score, milk score and attitude score. Tables 7-9 describe scoring guidelines for the clinical endpoints.

TABLE 7

Scoring Guide for Udder Score

| Udder Score | Clinical Udder Observation |
|---|---|
| 0 | Normal; the udder is pliable when totally milked out. Heat, pain, redness, and/or swelling are not detectable; cow exhibits no signs of discomfort. |
| 1 | Slight swelling; the udder is less pliable with some firmness as if not totally milked out. Additional milking or stripping does not return the gland to normal. Redness, heat and pain are generally not detectable and cows generally do not exhibit signs of discomfort. |
| 2 | Moderate swelling; the udder is definitely firm, reddened and warm to the touch. The udder does not return to normal size when milked out. The cow generally exhibits signs of discomfort (irritable, performs a stepping motion with feet and/or kicks) during prepping and milking procedures. |
| 3 | Severe swelling; the udder is very hard, red, hot and noticeably larger than other mammary quarters before milking with little or no change in size following milking. The cow is extremely uncomfortable and very irritable |

TABLE 8

Scoring Guide for Milk Score

| Milk Score | Milk Observation |
|---|---|
| 0 | Normal in appearance, color and texture |
| 1 | Mild - few flakes present |
| 2 | Moderate - Many flakes, small slugs or milk appears somewhat watery |
| 3 | Severe - Excessive flakes or slugs, large slugs, milk appears stringy, watery and/or bloody |

TABLE 9

Scoring Guide for Attitude Score

| Attitude Score | Attitude |
|---|---|
| 0 | Normal - bright, alert, responsive. Normal appetite/rumen fill. |
| 1 | Mild Depression - reduced responsiveness and/or decreased appetite. |
| 2 | Moderate to Marked Depression - may be reluctant to stand. |
| 3 | Moribund - unable to stand without assistance. |

Results of the preliminary phage safety study of Phase I trial showed no evidence of increased inflammation in phage-treated mammary quarters as compared to untreated mammary quarters. There was also no evidence of systemic immune response induced by the bacteriophage treatment. Results of the bacteria inoculation study of Phase I trial demonstrated notable disease development in infected cows, which was persistent through 7 days. The course of disease was characterized throughout the study period, including both clinical and laboratory measurements. All cows had an attitude score of 0 throughout the study, with the exception of one cow at 12 hours post bacterial inoculation, which had an attitude score of 1. None of the tested cows experienced life-threatening morbidity or mortality. The milk scores and udder scores of cows in the phage safety group were 0 throughout the study.

Phase II Study

In Phase II of the study, 16 cows were inoculated with a persistent E. coli strain ECC1470 in one mammary quarter each at a dose of 100 CFU. 4 cows were not inoculated with bacteria. 8 bacteria-inoculated cows ("phage-treated group" or "treated group") and 4 non-inoculated cows ("phage only group") were treated with the bacteriophage composition in the infected mammary quarter at a dose of about $10^{10}$ PFU in 10 mL each milking at 6 hours, 12 hours and 24 hours after the bacteria inoculation. 8 of the bacteria-inoculated cows ("control group") were not treated with the bacteriophage composition. The cows were allowed to adapt for 1 week before receiving the bacterial inoculation at time 0. The cows were monitored for 7 days for parameters including, TPR (temperature, pulse, respiration), clinical score, udder score, milk score, milk yield, complete blood cell count (CBC) with differential, Somatic Cell Count (SCC), and CFU in milk. Cows in the phage-treated group and phage only group were euthanized at the end of the study. 5 tissue samples were collected for each treated and contralateral control mammary quarter per cow in the phage-treated and phage only groups for histopathology assessment. Histopathology scoring criteria are listed in Table 10 below.

TABLE 10

Histopathology Scoring Criteria

| Score | Criteria |
|---|---|
| 0 | Absent. The histologic feature (necrosis, neutrophils, or lymphocytes) was not observed in the examined 200X field. |
| 1 | Minimal. The histologic feature (necrosis, neutrophils, or lymphocytes) was present in scant or very small amount in the examined 200X field. |
| 2 | Mild. The histologic feature (necrosis, neutrophils, or lymphocytes) was consistently present in low numbers through the examined 200X field. Normal tissue architecture was maintained. |
| 3 | Moderate. The histologic feature (necrosis, neutrophils, or lymphocytes) was a prominent and distinctive feature in the examined area (i.e., the majority of glands or tissue in the area exhibited some necrosis, presence of neutrophils, or lymphocytes). |
| 4 | Severe. The histologic feature (necrosis, neutrophils or lymphocytes) was an overwhelming feature of the examined 200X field. In general, all glands in the area were affected. Normal architecture of the gland was obscured. |

Results of the study are shown in FIGS. 7-13B. Safety data confirmed the preliminary phage safety study results of Phase I. There was little evidence of increased inflammation in phage-treated mammary quarters as compared to untreated quarters in cows receiving phage only. There was also no evidence of increased inflammation in E. coli infected mammary quarters treated with the bacteriophage composition as compared to E. coli infected mammary quarters not treated with the bacteriophage composition, with the exception of a statistically significant increase in somatic cells in the phage treated group at 12 hours in comparison to the infected, untreated group. The CFU data (FIG. 7) demonstrated that bacteriophage treatment resulted in statistically significant reduction in CFU of E. coli infected mammary quarters of the phage treated group at 12 hours. Systemically, the infected, phage treated group experienced statistically significant higher neutrophil counts at 36 and 48 hours than the infected, untreated group. The attitude scores of all cows were 0 for all treatment groups throughout the study.

SEQUENCE LISTING (5 sequences)

SEQ ID NO: 1 - DNA, 140255 bp, Unknown
  Bacteriophage genome sequence derived from the Myoviridae family
agaagcggattaatccgcttctaatacaattaatcaggagatggtaaagcatgaacacaagacgggtaaataaagcgttagacgaagcagttagattattagacaagcaaatagcagacacacagaagacaatgcaggagctaaacaaacaactagaacaacagataaaggctaagcaggagctaatgacattagttgatgctatgactggtgatgatgtttaatgaacattaaagaggttcatggtgtcgttaggagtgcaaagaacaaactcctgcaggagcaggagcatattaataatgtaatgatagatgactacatcacagaggagcttcacagacgcacgcagggaagcgggacaattcagatgaacgataatactcccgcatataccaatgatgcatatggtagcttaaaagagcttagagaagcttatgacctatcgtcattgtctactggtgagattaaagaattgcttgaaacatttgtttaaattcttttatcaaaacactttacaactacttaatttgtatgttacaatgaacttaacaaattaaaagaaaaggaaatgatgaacatgaaagaacaaatcaaacaattcgaaagagaacttgaaagagcagtgaataacttattcgtattacatgattgcggagtatcacaactagagcttgaagaacagaatcaaaaggttgtgtacctcaaagctattgtggagaacatgaaagcctacgaagaaattagagttgagccaaagagtgaagagcaatttttcaaagagcttgaagaagaacttgaagaagaagaaaaaatattaaaaggaatttaagaggagggcaaacgcccttctttatttttattctattatataatttttttatattatacgggggcaggggtaaaatgccactcaatgggggtgggtctatatagctaccccctctacccaggtacttattttttggggaaaattatgaaaataaatattctaaaagtcaacacctcctattataagtcaacattataaccctaccctataagtcaacaatttatagtataaatagatagcccttaaatataaagtcaacatatctaaaataaaaaaaagtagaggggttatcctctacttctcgttactctaccgtttaagtcctgttctatagtattcatatgctcccatacctcaatccagtctactcttgtatcatcatagtaaaggtggaagtcctgagggttttctaagtacccttctagttcatcaaagtataatacttcgaaagctgtatcgtcaagtcccatttgaatctttagtatatccttataccctaattgtttattaccgcagtaagctgtgtcctctaatctcttctctaatttattaaatagtgtttgtacgccttgtaattcattcataatgtgttacctcctaattgattatatacttagtatataggataataattagaatgtcaacccttattataaataaaaaaaagccactctattagagtgacttagattattcttcttcccatgaccactcttcagtacccatgatatcttgtgcttcaggagcatctacaatttgtactttatcattgctttctaaatcatgtgctaatatttcggcatattctaaatggcaaattgttttactaccgtctttattcttacgccaatacttcgtgttataccctaacttttgaaaaaattctaaatctgcaattacaaatttcatattatagcccccatctttctttttctaattgataattatgttcaatttcttggtctgttaatgctcggttgtatacttgagttgatagtaacttacctgtaaggtttgtatttccactattccatctaccaagtttggttaattttacatctgcaactggtataactgtatctgttgttgctaatttttcaccattgccatataatgtaacggttttgtcaaatccatttactaccattgttacgactgctttagttttattttcattttctaagttgtaaaagaacaagttaccaccacttgtagatgaaaggtttttatctgtatatactgagcaatgtagagcgttataatttcttcttaaataaaatccactcaatgtaaaagcattgaaaaattgtacagggttagttaaatccatatccacagtgtgactaatagtaaaagaatgttttaattctacatttacacctatttcatcatcgacattatcaaattttaatccgttgtcatagccactttggtttgtataaacgaagtttcttaataccccgtcattatttaagccacttatatctttagcaatccctttcgtactacttgtgttactcattgccttaaaatcataatataaaattaacccatcccttattggattaggatataacaattcattgccttgatatatgaacggaatatttttatcccctaatttaacttgtgacatatcctacacctcacttatgaaatacaacgtattactgtctttagtttcaagttgattgtattcgtctctcgtataaattttaggaggtacgtaaactacatcacctgtatccccttttttacctttaatttcttctttctcttcttcagtaaggtcactaaattttaagggattacctttttctcctggttcccctttaatagatttaacccattcttcttctgttccttcgaatccattatctactgctatatcataagctgttttaggtttaacagttaagatgtctttagcataaaaagtaatctctttataagaagattctaatgtagtaaattcaggaactacagttttttctgactcgtagttatcaccttcccatgaaacataaaattccccttgtggataatgtgtatgtggtgataagttaggtataataactgaaccttggttgttctttgcgttataacctatagctaatatattaccttctttatcataagcttttaaatgaggcatttataattctcctattctattaaattcttatttataatataacatataaagtatattttatgctttactctctatagtaatcgtatatttctaggtaaggtgaaaatggtgagtcacctctagtattaataataacttcaccctcttggttacttatctctgtaagctcttctaggctattaatttctacacaccatcgttctagtgtaaatggattacctttttggtctacacgttctagtttctttatatagacaccttctataggctttttattaatggtgcttgttctatctataaaaaattccattagttatcctccttttcataagaccattcaccatattctgcgttaaaatgggctgtatccgtaccctcgtcttcatattctacactataccatgcatcctcttctgtttctgcatctatatatcttacttcctctgtagtaataatacgttttactttaaatctttccatattagttttcctccttatattctttataacttttaataacaatcttacagatacctctattaacagctaaaaacaataaaaatgataacagagttataactgctctagtatctcctgtgaaaggtaatactttaaatagtaaaacactttctaaaacacttgtagctgtgataattgtgagatataagatagatagtaagtaatcctttaattttagtttaacaaaaggttttttattatcttgagttcttactataccatatagaattataaaccatgcaacaggtatgagctgagttataaagtcattatttatgtctaatgcatataaaccataaatgatacctgcaggaataccaataatgaatgctaaaaatacagagaatataattagcattataggaagagctacaaggaatcctaagccttgttttgagtactctagtgtgttctttcctaaggatttaaagaatgttttattcatcttcttcctcctctttatttagtatgctatccttgccctgtaaatcatctaaaacttcataatataatatctccccaaaacttaagttttcattcttatacttttcttttatatactcatatgcgtcataacttttttcattaatatcatacttaaccattattcttcccctctcttaataaaacttttatttaccaacttttttaaatgtgaatatgacataacattcttctgtatgcatagtgtagttaaaacctgttaattctttttctatacgtttgacgtaatcactagatttatcatctaaatattttctttcattagagaaataatcacttccatagtcgaatatgtgtgtaagtggtatggtgttagctaatcctacttttgatgcgtagataccatattttccatcataatcatatcctagatacaaaacacaatatctcaatgtgctcttctgtttaaatgctttgtcaattttattgtcacctacacttactttaaatatcaattcatttttattcaaagattttagaaaatcgttcatcttcctgtatttacggtttaacacgctatcgtccccttcgtctgtacttcttttctatttatttaaacctattatatacgcaatggactcgaacatcttccattactttacctaatagattctgacctttccagttgctttcatctaatatcttagggtcatttgctttaagtcctactccccatattttatcataaggtgatgcttctacgaaatctttacgtaaatctgtatctagtattttttgttttaagtgtgtagtcataaatttatctttaactacctctaccataatgtcatatcttaccttattccattgctcttcattaaaattacgaactttacgacctagacttttagcatggttcggatgcttagcatttaatatttctcctgctatttgccagtctttaaaatattgagctttacgccacataaaggcttgttctgagttattaaatgttcttcctttatgtttaaactttattgggtaaaagttagaatagatatcttctttaccccaaaacataatgtattctttagtctctttcatattagctcccctccaatttaataagtggtaaatctatatccctaaatacagcacctacatcacataacaacatatcattatgttcttctacttctccactaattgtaggtgtgtgcccgcatacgtgaataaaaccatcattacgtggttggaaatctcttgaccatagtaattggtctttggtttggtttttagcttgtttccaactaacccctcctgaatgcgtaaactcatacttatcttgcttatatatagtagcacagttatgcattagtatcttaaactttctatagtcttcagactctttgaattccttaatttctgcaacgaatttatcgaagtattctctataaaacttattttggtttaactcaaaactctttaatggtgttgtgtctataccatatgactctagtgtttctatacagtatcttgcaaaccattcaacattatatatgtccagtttatcaatattttctatactatgccaaaatgcatcatcatgatttcctaataaaggtataatgtcatcatcgtttgagactctttcaaaaacgtagttaactacctctctagatttataacctctatcaatataatctcctaaaaatactataacatctccaggttgtctttccttgtctatcttattcataatcgttattagtttttcatattctccatgaatatcaggtactacatatatagccatttaatctcctccttattgtatataactatcttaccatacttatttataaatgtcaacaaaaaaacacctattaattaaaataggtgtccaacagagctcccgcacttagattacggttaatagtattttacgacatttgtatgagtatccctgttgttgaaacgctcgtcactgcgttaagtatatacagtggtttagctgtcttatggagttcctctaagctatacagagaaaatcagcttccttatgttgtaacccatctaaccataaacttgagttacacgccaagtgtcagataccttattcaaggctcggtatcttaagccttcactttatattctatgacacttcttctgaatataaagctatccaacttatttcactctcaaggtgctacctaattttgagttatccctatttggaaagtaggtatggttcacctatcccacaagatattttagaaggtagcttgtgggagaagattgtttttttatgtaattatagataatacaggtaggaattgaacctacgacacaaagaacaatgtctcctgctctacctagctgagctacacgtattatctattaattttagtgggaaaattggaatcgaaccaacattttatctcggtgcatacccaagacgtgtaaagtatacctctctactgcctacctaaggtttcccactatgtattagctcacacctacgtaaggcaatgagcttagttatttagatactggagttggaagggtattaccaatcagaatcaacagtcagatacaaagcctctgccgggcaacatacggtatctctcgtacatctctattacagtataccacaaaatatataccgtgtcaagttaatttatcatttgtattcttttgtaagaaattctacagttttatctttaagtgatttttctactaactccattgcgtctttatagtgttttatattagattcattagacttcagtttatcttttacttcttgaattagaggttctactttattaactaggtcgtctcttttttctatacttacattacttctcttattagctaaaacatctactggtatatattttacttttgcaaagtctttatagctgacctgtagattatctaaatcatctaataattcattataatagtttaaatggttatagaacgtatagaatttaaccaagtctttccctgttaattcttgctttttaagaatgctattaatattacccattaccgagtaagctaaggttttaaaattagctctcacataagtcataaatacaagctcatcataaaataaatctaaaacttctttattgaatctagtatttttagcctgctctaattgagcacatagattaagaacattatcaaaaccactttttagtattaaagaaataaacctctctaccgcatagtaccttgactcttctgtatgcttactagacttttcactattacggaaaactgtatctgataagggttgaactactaggctcatataatccctatctgagtgttcatctgcagtaccttgataagtactaccgaattctattttagataataaaacacatttttctaaattcattaatgtaacctcctttattgttaacttaattataccatatcaatatcgtcttgtctatacttaatacactcatatactctaaataaaataattcctaatactactagtcctaaaatatatttcatattaaccctccttaataaccgtgtttagttatccatcctgctaaaaagcatccatagccctataatattcttcttcatttttaactcttataatactctcaatctcttcttttgcctgtttagaatccatgaaatcaatatctactttatctaaatttgtgtagcttatattttcttttatgaactttttttgtgatggtgttatagaattaattcttacattttctttatttaaaaactgatagaagtccatattattcaccttcttccaagcagtctgccatatcttttaatacgttaagtacatattttaaatctctatagtggtcgtcagaagaataaatagtatagtaaggtatcatatcactataatgggcacaatcaaatcctaatactatataatcaccttcttgctcatcatacgtaatacctccatgagaatggtcttctatatcattaaactgctcctcagttatattagtaggtacattaatatacccattaaaatgtcccatttcaggatgacgtttaacagttaattttatacctttataatctatatttaaagttaagttctctcctaatatattattctctttctcaatagttttcataacatgttccggtgctttgtcaaacatatcaattcctcctttatttgattacatatataactatacactaaatactttaatttgtcaacaaaaaaaagactactaattaaagtagtcttaaaattaattacttggctttatatttccatttgaagtaaccatttttctgtgagaattcaaagtggaaaccatcgtagtcaaactgaatgtcataatccccgtcttgaagcggttttgaatttagtaccggactattactttttgctaactctgctagaaactcatgatttacttgttccataaggttaattcctcctaattattcttacagtattaatatatcacaggtctttttctaggtcatttttaaaattctcttcatatgaacttgcataagtaacctcatatcctactactttattacttgttatgtgtaatgttttatattcatcttttactttaatatcctttgattgttctaagttatttaaaacttcatctagtatatctgaagaatagtgtacattggttacctttattgtttctccgtacgtgtagatatcaatttcttgtatcatcttttcatccttttgattattcattatttgattataagtttctaaatcatcaatactatctgtatctgaacctttcactaaccactctcctctcttcttcaggaggtcatcaaacttctcatgttccttaactaacttttctacttcactaggtattagtactgctctagcatagtttatatgccacatagacatattatctacaaggtagtcaatcattcttaatatttctttttcgtttgccatataccgacctccttatatctaatattaatataagagaaaagcagacctattaaaggtctgcttcttcttttaatcctattcttctatctttagtgaaaggtatagataatctatcacctgttaatagggatagctctctagctttttctttagataatgttactaacccattataattatctactttagcattgtattgctgtactaaaagttctatttcatctactatacatcctaattctcctgatttgacaccgagtaactttctatacatattataatctttagaaagactttctactttatttttagataaagaatcataaacagcttgtaaattaccttcttcaacaagtttaaagttatgctcacctataattaattcttcctctgaagaatctaatgttactaaaccactagttgtataatcttctataacgtttacaacaacaccctcagtaattttctcccctaattcaatagttccgtcttcattttctttaaatttatgagcatcgtatacttctactttatctcctagtcttaaatcttgagttaaattgtgtttaccggtaattctatccattaggcattctcctctttattaattgggtcttgtgttaaaaacatttctaaattatcttttgtaatagggaaccaaaaatactgactgtccggagttgaaactgtgtaaaagtcctctccttcatttactacaatatttactggaatgaattcatcttgcattaaccagtgagtaacaactatatcataagaaccgttaccactataacttaagtctaatccatgtttatatgctaaatcttctaaatactctaataaatcatttttcgtatcaaatttctctgctacagtattatctttaatagggttaattagctctgtacaaacgatattatataattccccttctgtaacttcataattattttcgattagtacatcttgtagtttattaatagagtttgtaactacttttccatattcctcttctgtaaatttacatttatctaaatcagcctctgtaattagttctgaagtccatttatttaaaattgataccgccattgttctagaaataatattatcatataacatatttatttaatctccttgtttaggtgaatatggtcttctaatgagaaatcaaaaggtgcttcaccatttattttattatttttttcttttttaagtataacacatgctagtggaaaagtcaagacagttgctattaatattattgaaattttatttaactttttcataactattctaactccttaagtttattccttactttatctttatcatacttataatctttttcgggtgtgtttttttcttctttgttaagctctctatattgagcttcttctacttgttgttcttctttactatcttccttagattcctttacctcttgaactttcccttggttactcgaacctccaacttttttcttaaaaagaaaccaaagtatcaataaaataacagataaaatgatgatacttagtactaccgcccaaatattattaatcattatagtctacctccaaataatttttttactgctcttaagttttctgatgaatcattgtttatgttaattcctgtacttgaatcaaagattacagcattatcaagtaaatgttctttaagtttattttcataactatcttttccggttacactaccataaccaccctgtgttaaatcagtcatatcagattcaacttctaatactctaaatgaaattctacgtaaaaatgaagggtttactaagtaaaacgatgatttaaaaacatttaatctttgataagaatgttttatgttaacaacaaacccagtaagtttaccagtacgacttgagtttgacagtttacctaagtataaatttatactgtatccttttgtttctaatgtttgtatagcactcaacattatagcccctctatacgcaagattctcagggtcttccatccaacttatactagaattatagaatacatcaataactttcttctctgctttgactctctgttgagacatcatagaattaggtaaaccttttatagcattaggtacatgaggttgataaccttcaggagctataactggttttctttttacagagttatccattctgaataaggcatctgtcatctttttaagtttaacaaccatatcatatgactctctatctcctttaaccattaagttatatgcttcattaaagctatgagtacctgtgaagtcatagttacctgtatctgatgaattgtctctacctgaaactctattcttttttaaagcagaaaagaaatcaggtagaccatcatatttaattacatttaattctgagttatctattaatcgtctacccattgttttttcctcctattctaatcctaatttatccataatagtgtcgaagtccattgagtcactagatgaactttgagttctactaggttcttgcttaggttcttgcttaggttcttgtgtgatttctaaaagattttttgttgcttttgtatatctattatcctcaggtaaagagctaataaattgattaatctcatcttttggtaatgatttaaagatgatactttctacaacaaactcatcgtccattactccatctaatttacttccattaataattgcacgcattgagaatacataaggtaatcctttttcttcgttttcatatcttaatttctgtacaaagtttactaagtcttcattacttgataattggtgttctactttattatcataagtaaattctacttgagcaaaacggtctaatgtagccccatcaagttgctgtctacctacgtaaatgtggtctgctcctgttcccatagtattacctgctgatactactctaaagtcttcatgtgctgatacacgaccagtagggaagtcgaagtatttatttgcaatagctgagttaagaattaataatacttcaggaatagaagcatccatttcatctaagaagaataatcctccgtttgtaaatgctttatagaactgagtttcatgaaacttaccatttgcatcaataaatcctgttaatttaaattcttgagtgattgcattactgaaatagaagtctaggtctaatgcttctgctacttgttccaatacatggttcttacctgaacctgctccaccttttaaaaatactggaatgttttgattaactaattttagtatatcttggtatctgtaatggaagattcctgagatgtccttaattgtttttccttcttgttgtaattcaattttaactggtaaattactaagttgctcttctacatatgtttcaatttgttttttaacatctgtaataattatttctctactttcagttcctgctttctcaacaattgcatctacaattgcttgctcataaggattagagttcttctctcctagtttgtctgctaagtcttttgttgtttccatctgttgttctaccaatttctctaatctttcaatagtatcttgctttgccataattatcattctcctttaatttgttatacatttattataatacaagtatttatgtttgtcaacaactttctaaaacttttttttagttgttaataaaaaaataccttacacctataacttaacatagggtaaggtaattgtcaacactttttttaagaataccttaaattaaaaaagtcatctacatctttagtgtcgtgtgtatccatatcatacataaacatacaattatatgtatgattattcaatatttctagcatgttatgcatagaagttgcattatctaattcttctaaatcaatagttatcataagttcttgaccttcataaagtatgtttgctatataatattttctaacaccttccattgttccgtgggaggtttcattatgattaagaacttctatacctgttgaaggtaagtattttgaaaaatagcatttgcagaaatatatgaaattgtcttctcttttagacacgtgtactatctccatattttatatttctttctaatcttacataataggttttaatcttttctacttctttttcaaccgcatcttttctgcctaaacgagtagtgtattttacaatgttgaaaatcattgagtctacaaacccatcataagaaaaatgttcttctaagaaggaaataacatccttactacctttatagtgttcaggtaaatttgcctctactgatatgttataatagtcttctagtaaaccaatactttcacctaaactagataaagcataagataaatcattcgagtcattagaccattccttagataccgttaatgcatcttctataactgttatttttaatttatctaaatagtcttctacttgagcttgtgttttcataaattcttttgcgttcatttaataccctcctaaattatatataaaaaaacaccctgcttgagtacaagcaaggtgaaaaaggaaagatattatggaagtgtactatctaagtacacctcataatataacagttttccttgccagttattccttattttttaaggtcttcttccttaacaaatacaccatttacaagtttaccttttcggtcttttatttcatcatatgccatgtcaatacactcttcgatatcaatgtctaattgtaagcatagtactgtcagtactacaaaaatatcccctacgctatctcgtgttacatggtcattactcttagcaatacctgaagctaactctcctgcttcctctagtaattttagcatctgacctgcaggttcacctgtctgtaaatttctatcttgtgcccattgtttaataagttctactttttccattattccatatctcctttaatttctgtatttttaataattaagttatcagagtcactagttatacttatattatcttcaactagttcatgcaggttattagttatgtcctcttcaaacctataacctacacggacgtatgcctttactctaatatctatacttacataatcttcctggaatttttccatttctaacttcctttactataccatattattgacgtattgtcaactattctgcataatttcctttagcaagctgatactttttgtgtaattcttcatataattttgacatgtctttataattcttgatatcctgttcatgatgacttaggtattctattaatgtcttagcttcttccggttctaaagttataactggtttaaccatttaggcaacctccttaaattcttctttatttattttcttaatatctttttctaatgcttcttttagttcattaggtaatttataagcaccaattgattgttgttgacctaatacataaccattatctgtaatacgtatctcaactgtaaaccatgaattatctaaatcttcttctaatcttgctaataatattaaacagctattctttataattctattagcatatcctccaacacaatgagatagcattctaccttcatcttttaatttacttacagtatccgcaggaaggaattttacttttctaccgtcttttaatttataagttttatcaattattttttctaacttattatcatacttagctttaagttctgcatcatctaattgttgttgaatggattgtttttcatctgttacaatatcatgctctaattttaatgagaagggagttaagttaacactctctaatgttctatacccttctctgattagtattgataaatcctgtaaatagtcagggtaatacctatctagtgcatatcctgttatacgttgtctgtcttgagcatctacatctaaatagtgcgtcatctttttgtagttagcaaaagatatagataatatttgatttacaataggtttaacttttaaagcatcagtaacatctcttgaatctcgaaccattaaaaaagtatcatcaaataattggtgtaaattaacctcattgtgtaaatgattatagtacttatatagagtattagcaaatcttaagtaattaccttgctcaaatttatttaaagttagtaattttttataagtctgttttgtaagattgaaagcttcatgaactttccatttaggatttttaggtatatgaaatagtaatgcatttctttcaaataatccaaattcctctaagttatttattttgtcaatatttttaacaatatctgttaaagttgttaagtaattagaagttgaattttctcctataaaaatcctatatttgtctcctctataatttatatgaccataaacatctatattatccggacaccaactagaaaaatcaaaattatggtgttctaatgtttgttctattatctttattataacccctctatttaagttaggttgtgagtaattttttaaaataacatttaataaaacagataatgtcaattcatttttatattcacttttacttatatcatctttatacaaatttaaagttagttctttattaacaaggctatctgttaagaaaactttaacctcccctgttttaacatcaaatgaacttttattttctaaaacccatttattacccatattatgtttatctctgatatgtctaactttaagaccgaaagatgaattattctcagtacctggatgcatgtaccaagcactactatacaatgaatctgatatttccttataatacttacttgagcctttttctgtatcttcattcatataagaagtaatagatgattttattaaaccgtacttaccttggtctagaatatccataatatcatcatttaaactctctactacttccttatactcatctaattgtctagcttcatacccccataatcgggtttcattttctaattctttaattttttcttctacataacctttagattttatttgtcttctgctcttattaccatataaaggaaattcttttctttcttctctactggattcaatatattctttgtaatttcttcctttattttctccaattacaccttcaactaatttttcaactgtttcataagggttacctgtaaagtttgttacttctttattaccacatagtgctaagaataaatgtatttctgtagcagtatcaaaactaaatatattatgaatatctctaaataattccttagagcctaagttaattatattatttttcttcttcttaaggaatacatcttcttctcctatgtagatacatcctttattaactttaggtaaattaataatttcttgttctgttaatcctttttgtttatatgttattgccatttaaaatcactccttatttgttatgtactaatcatatcatagtaagtcatatttgtcaacaaaaaaaaagaagaactttttaaagttcttctaaatgagtttcgtatataaccttttgaattttatttagtggttctaaatctaaattcctaataagtttttcgtattttcttgaattcttgaagttaatagtattaggcatagcaagagcttcatcaacgtctttagtatagcttacaacatctgaatagatatctacttcttttacatatagaccctgagttaaacttctaaatactacctcattatgtgctataacttcttctttcttttctatgctcatttgtaaacctcctggtttattctacccaaacaagtacgtactctaagctagttaatgatactgatttaatattatttaattcttgcaatttcttaatatctacatcatagtttttacttatagtccataatgtctctcctgctcttactttatggtaatacttattcccctctttaataaggtcatccaatattacctacctccttgagtaataattagcctgtagataacatataagtataagaacaaagtttacaaattcagtagctataatatgaacataggtatgtgataaaaccatacttactatcaacgaagctaatcctaatccaataataaggaatagaaatctgtttgtcccttctgaacttttagttttataaaatgttgttatctgagttacatacgcaaggataatagtaatagttgctacagtttgtgttaaggctgtaaagtcacttaataaaaatagtaacaatgagaacacaataataaaaggtatagagaaataatccttttttctatatgaagctactaataagcaaacaatacctagagttaaattaagaccaactgatactacttgaaacattgtagcatcagttaatagtaaattgtaaaaactaatacctactgtagctacaattaaataccaaaaataactactaactcctttaacactatccgatttaactaaagctattagacctggtatataacctactgtaactaatatagcatataatatactcaagtaatgtgataaattatccatcttgttctcctaatttctctaatatttctaaaacttcttcccaagagataaatccttctccgtctgttaattccaaaaccataccataaacaaattgatttgtactaaattcagctctgtccgggtcgtcataaccttttccatgtccttgacgaatatccgagcaataaattaaaacaggtttatttacaatattttcaagtttttctacgattaattcctcttcttcacttaaccaagtttcaaatctatctgatatataattaaagtgttcttctccattatcatatatatggttaatagtttcttgtgcttgatgcttcatacctagtaaaataccaagttctgcaatcgttcctagcccctcattaagaatatcaaacacaaatatatctgagtcttgcatagctttaaagtcattgtttaaaatgcgctctgctaaaccagtttgttctgcattagccttatcattaattgatttatctttatgagggctgtaaggagtgactcctacaataccttctacttgcttatgctgtttgtctctataatctaccatagcttggttaagtagatgacctcccatataaattactttgtctttaatataattaaccatttatagtatctcctttttcttctagaatacctcttaaaatgtgtggcatctttttcttaatttgtttttctataattttcatcatattttctttttcttcttccataatatcatcaacaaaattttgacctacttgtttcataattaaaccaaaattttctaattctaaatcatcttcagacaatctgttttcttctatagctctaaaaatcattttttccattcttgattttgtgatagcataatctgccacagaatcattacttctaacttctgatttcattttcttacgactaaactctttaaattccttagatactaatttaaagtaatcatcatgttctgatttaccatctaaatatttaataacaataccttctcctgtattaggtttaacagtcatatctgattgtcctactaaatcttgaatttcttgaggatttaattcattaagataaaaagatggttctacaatcattaaagtttttacagttttcaaacctaatgtttctgataaagaaatgacttctgaatgaggtaaataggtttcactatccttatcgtatacatcgaatacataaaaatcattataacaatcttctttataatttaccttatgtttaactaaccattctccaaatataataataccttctaatatagataaatctaatttatctgtcatgttttcatgtacccaattataaaaaccgtttaatgtttcgttttcatttaatttttttctacgagagaaacagactaactcaccattctcggtagtaaaacttgcgttgcttccatctaatttttcttgaattacaaaacctctatctttaaatttgtctaaagataatcctttattttttactttagtataagatttcattaattagttatcctcctttgaattatgtactattgaaaataaaataagacttacacttgctaaaaatgctaataccactaaaccaggtaaatttagaactgttgataagaataatgatattgcacttataatataaactaaaccgcttagaaataaagttaataatacaattgttataagttttaccaaccaactgttattaataaataccttagctaaataattcataaaaaatcctccttagttattataaagtaagtatatcataactaaagaggtttgtcaacatattattttaccatttaaaattgtctgcgtactgagctaacttagaacggaaattaactgtaaaattatggaataccgcaccatcataatttttaaaatattccatataatctccaaaacctgatttactttcattttttaaatctatttgcttgaaatttccttcaactattactgtagaattttttgtatgaatccttgtaagtactttcttaagttcacttcgtttaaagttttgtgcttcatttataattatagtagcatcccttaaattaccgcctcttaaaaataaatgtgatatttgggatacccaacattcacctaatttatcttctttgacattatcttccatcattaacatttcggttatttgttgttcaggactcatattaagttcaataagggcatcatgtaatcccatgaaataagccatttctttttctgtttggttaccaggtctactacctaaatcttctgatacaggtgaaattacaaatactaattttctgttcttatttagataatcagcataagcacaagctactgaacacattgttttacccgtaccggcttgactttcattccaaagtatttcaacattatcattaaagaaatcctcacagaaatctaattgctcagttgtagctttttcaaggaattcattgaatactagatgttctcccatgttatatcttacattaggataatcctttaacttaaagtctaactcttttagttgtattgccatattttaaagttcccctatctataaatagttttactctcttttaatatagtactaattacctatatattcacctgttgaagaacaatagttactgcagttacattcaggataattttcacaaacttcttcatcttcatcatcaaataagtcttcatgataaatactagaatcaaaatctacaatacaattttcccctttacctttagatatgcctgtgtaaataacttcatcaaccatatcccaatcattacttactaagtaatttacagtatttgatactgaatcattatcaggtaagtagatatcaccatctgtaaacttaattaaaatatctccttgagggagtacatcattaattaaatcaatttctgtttcttcttcaattgtaaatacagttccttctagcttttcaggagtagtatgtgttaaatgtttaacatcttctcctgattcttcataaaatcctactgcattcatttccttgttatactttgcaataaatttaccattatcactgactaaatattgactgtttgcattataatcttctgcatcttctaaagtcatagatgggttatggtctttaacataataactaatttttctaacatctgttgtttgaattttctttccttcacctttaattactgaattaatttttttcataatattttctcctttttatatatcaattgatttttttgcaagattatcagcgtagtcattccatttatcatttgagtggctttttacttttacaaagtttatatctattactttttggtattctcgtatcatattaatatatgttttacttagaatatttcttgcagaccaagtaccttcataccaatgtattaaaccaatataatctatataaactattgcctgattgtatcctaattttatagcctcttcgataccataacaacaagctaatatttcacctgcaacattattatactttatcaatcctggtttgtcaacacttttactaatttccgctattatatttccttctttacttactaagacagcacctgagcctactttacctttattataagatgagctaccgtctgtgtatatatttacactatcctgcatatttataatcctccataaattgagggaattcacaatctgaatatacttctctgcagaaagatactgaaatataattaaaatcaaaacatttgaaacagtgttcttgaacttcttttttgtctttagcaatcacattaaatttaaaaccatcagctattactgtaaatactccttttttcataaaacaaatacctccactaattttattttaaattaataactaactcaataaacgatttaatagttttatttttaccttcatcaatatctgaaaagaaattaattaaactatcatcttcatcaaataaatcttcaacatcatcaaatttatttaatatatctgtaacactataaccttcttctgatatatactcatgcaagtcttctccatcctctgacagagttgcttctatcttaccattcttactttcaattaaatacaaagtatttaatactttaatagaatctactactacactgtaattactaatagtaggatactctgtataaagtatttccacattagtattcatataactatcaattacagaattaactgtgtccctttttaattcagatacattatgttttcgtatagtagggaattcttcgtcatattctactaattcttttctatctgtattcaataatttgtctaaagaagataataatactattttatattgattgtccggtagactatctgtaatttccataatggttaaaaaagtatcttcacctaaaactttatttatatcctgtaattcaaatgaatctaccatttcaatagtatcatctatatcatctgtagtcattaaaaaattaactaaattattattctccatcgtcttcctccaattccttaaatagctctttacctggagtatttaacgccttctctaacctcattaaattagcacttcttggtttctttttaccatactcccaataagatataagagaataatggactcctatctcagaagctaggcttcttaatgtatgtcctttttctactctaattttttgaagatttagaggtttactttcctttttttcatccataactatttctcctctacttttaaaaatttaaaatcctcagatgcttttgcattttttagtatatactcttgtgatttatttcttgcctctgctttacttttagcatataactctatatgaaatacatgaggtttttttaaagatggtgattcatatctccaataaactttaaaaagtagtgtttctttttttagaacattaattcgaaaccatcttttaaatttattcattcattatcctcctttatttatttgttaaactaattatagcatagttaacttatgaagtcaactataatatacaaaaaagactaagaaattaatcttagtcttaatatattaataactattatgtgcgttgtggtatgcaagagctcctgatgttgaaccgtaacggtcaatcatatattgttttgcacctttagtttgttctgctatagaacctccactccatgatttccctaatccttggaatagtccttgagctcctgatgatgcattaacggcattaggattcattgtagattcacgcatagcaatttcaatcattgcctcgtctccacctgcttgtctaatttgttctgctacagaacctcctgtagaactagttgattgtgtaggttgtttagtttctttttgaactggtgctgatgttggttgtacttcttttttagtatcttgtttattttgagtatcaaattgcgcttgttgttggtctactttttgttcaggtgtttgttcttctcctgctaatctagatactgtattatctacttgagttgaacctgagtgatattcgtatccaaaattaccattataattatagaaatgataagtaaattctccgtcactgaatgagaaatcatagttaccttcttgaattggttttgtatttacttctactgaatttgatttagcttgttctgctaacttattataatcaatttcgtctgcactagcttcgtttgtagcaatacctccaaaagtaatagccgtacctaatgctaatgttgcaaaaattgttttcttcataaatttaaaactccttaaataattttttagaattgtttatttgtaaatcgacataagtaatcataacatatatctttaaataacgcaagtataatatagcactaattagtgtaatattattaaagttttattacaaacattacagttatcagataattaaagacaaaaaaagagaggtattaacctccctaatttattatttccctgttacgtctacgatagttccgtctccgccaatttgaataggttgtttaccatcccatttttcaattaactgttgacgtaatatcttatcagataaagaagattctctaatctcattggcttttttatcaccattagcttctacttcttttttcttagcattttgttcagcaatttgtttatcaactttagtacgttctaactcttggttagctttaacacggctgtcaattgctttttgagtgttcttatctgctttagggctagataatgcaatatcctcaattacaaatccttgtttttctaagttatcatttaagctatctaaagtatcttttttaatttctcctgtcttaacaccaaatgcatcaattacagaatatttagatactgcctgacgaacattatcttgcacacgtgaacgcaagtatcctttttctagttcttcaatatctgcactaccaaaacgattaaataaatctacagctttagttgcatctactttataagatacatcaatatccatttgtaaatttttgccgtctgaagttgctacatttaaatctttatatttatgtgtttgtgttttagttggatatttatttaccttatcaaaaggtgctgttaagtgccaaccaggtgatttagtatcttccttaacaccatttactgagtatacaactccaacatgaccttgtggaatctttgtaatacacattaataaaataataaatcctataattgctaaaaaccctaatactcctgaaataactactgactttctcattacatttctcctttttctatttcttttattaagctatttaaagctttttcctcttggtctatttcttgcttatcggctctagttacaattgattgtctgcggtcgtttaagaattgttttttatactttacatattgttctaaaccgtattcatctaatgtaccttgcctaactaattccctgtattgttttcttatgttacttttcttttctttcattgaaagaaaatcgaatacataacttataccaaaacctacaaggactagaaaaacaataaaaatagcaaagtatgttaaaaataatgccatgtaattcctcctttatttgattacatatataactatacactatgtatttaattttgtcaacacttttttgcaaaaaaaaatagacggattttaaatccgtctaaatttctattctatttgaatactccccaagcaaccccaggtatatgattaggtggaactccttgacaagttctaacagggcaatatactctgttaccattgtaagcattgtaacctatccaaatgtgacctgcttggatacaaacttcgtcatatacaattgtagctcctgccggtaagttacctcctactggagcatttaagaatggagaacctattctagttactataggttggttaccattaacaaatgttgcattttccggtttgtaccaagttccgtactggttctttttccaagagcctgttactggtctagttgccggtgtacttgcgctacttgttttaccgtctttaactactgtagaacttgaagttcctttatccatgtagtttttaatttgtttaatgaaataatcttttagtttattcattattgcttgagatggtcttccttgtgttactggattaaatcctgtatgaagaaccatagaacgatgaggacaagctgttggaacaaattccatatgcaatcttacagttttacgattaggagtaagaccccattctttaaatttctctgcagtaaattggaatactgcttgttcgtttttaaggaattgagcatcactagcactcattgattgacagacttcaatacctgcaaatctaaagttacctgagtttgctcctgttccatctcctgtgtgccaagcaatttgattcttagcatctattgcttcccatacataaccttcagagccatagtaatgagcaataccattagcatatctagcataacctgcgttagctaatgaattctcgtattgttgccctgaagaacgacctgcatcgttgtgtattaccattccttcaggtttcttaccacgtttatccattgtatagttaatatggttcttagaaacttttagtgttgctttctttttaggtgcaggtgttttacttgcacttttcttagctgtttcttttttaacagtagttcctgcttttacaggtatctcaataaaatgagttaatccgtaataattatctacacgttttgtaggttttttattagcgtaaccgttccagttttgctctaaaatagtaaatgtagaagtattacctccatcatatacaatacctatgtgaccccattgctgataactaccggatgtaaatacagcaatccatccttttttaggtactgtagaaggtttattttcatgtattttaaatccagtaccataactttgtttgatttggtctttagcattaccccaagttctaactttattatctgttaaccataatacataatcagtaattaagtcttggcactgtgcatgatagtaaccatctgcgtcaattgctcctgcttccattacaccaaacgatgggtcatagcttgtagcttttttaattctataaggactgtctactgtaccttttgcataagcgtctaaacgtttatttatttctgcttgagtcttagccattacttaacttcctcctctgcaaatactttaccgtgttcctcggtatcttcttcatcttgagaaggtgctgaaccgccatcaatttcatcttcaatagcaggtacttcatcactatcatctgtatcaggttctgcattgttttcatagttgtctaattcgaaagtgctagctgtgtttgcatttgcttgccattgaacaaattcattagggtctttactatcacgaggttttatataatctgtttgaacaatatcactatctttaagacctttagtattattatcaacaataatacctaaacctgctaataatgttagtatagaacctatgatatttacaccttgctcaatttgagctgagtagtctaaaccaaaagcacctgtaatttgattagcaaatactgctactgctgatataattgctacccaaaatgttttactcttagttcttgtgctaaagtttattcctccaacaactttaggttgtttagtttcattagccattaaaaaaccgacctttctattatatttatttctaacaataatataacagtaggtcggtcatgtttatctatattaatttaacacttactcattaatttgatttagttttttgataacttcagacatttgtttgttatctaaatcttctaatttagtttcaggtaataactctaatttatcccaaacttcttctttattagatactttattattaataattgccttaccaactaaactttccgtataatataattgctttgctgatgccatttgtatctctccttttaaatatgtaaagtatatagctagtatcgtatcctaggaacaaacacttgcgctatatactcaatgaaactctaccctcattcgaggacacagcaaaccgattcgtcaaccgcacatgtgaattctcaagtttcatttatgtaacacaccctctttgatttgcacaaagactaagggttttggagacccttgtactactaattatactaagggtgtttattatggtttctattggatttgaaccaatgacacctagagcttcaatctagtgctctaccatctgagctaagaaaccttgtaacgactcatacgagactcgaactcgtactctctgccgtgacagggcagtgtgttaaccagttacaccaatgagccaaaataaatgctataccctaaccttaccttaatgtatagcaggttttctcttatgctcgaagcattatgtggtacataagaaggaaaatatttaatatttaatttgagttttactctcttttatagaaccatcatccaataaccatggaaaattctttctattgactattctactaatactacttttatttatattataaagtttagctatttctgatactgttttatttccagtatcgtatagttttcttatatttaatacatcttttatttctaatttacctttattgtttttaccaccgtatctatatacatctaagtggttttctgagcacgtatcatattttaaatttgataactcgttattttctgagttaccatcaatgtgacatatttcgtacccttcaggtttttcacctatgaaagaaatggcaactaaataataagtagtatatactttgttattgttattatttctcaatgtaacaatatatctattatctttatttttatattgttttagtattttttctttacctttaaaactctttacattacctaaattacttacctggtatattccttcatatccgggtatgtctttccattgttctatgtttttcattctttatctcgacctttctatgtgtttaaataagtaattaattcggtcgagtaaattaattacttatttaaacacatatttcctatataaggattactaaaagcaacgattattaccactcataacaactatatattaagtgaaaggaggtgaaatgaacaaaacgtggtaattggtacttatataggaagtatgtataatctacaaggagtaagttattggttcataaaggagtgtgaacaataaatacatgaaagagtgaaagtctactccttgtagattcttttttaattatcaatcaaaggaggaaactgataattgttaataataaactataaagaggaaaatatttatagtcacattctgatataatgcaactaaatatccaagcataacccgtctcacgaggaacctacctataagacctgttattaagtgaatcactacgattgactctattaaggagctaccttaagtccatctcacgcaatttaaaagggacttacaaaccgtataacgatagtaagtttattaaataatgtgatattaacatattagttaataactttcacatggtcgaagaaaagtaaatttatttgatttccaaattatttttatcaaatatagcttcttttgaacctgtagatttatgctactcatactaataacctctattatctaacacatttctgtgctccaactacagttagtcgttacagcgtatctttctaggattccgctaagaccctagaaagaaattaaaccctagccgttatcatactctacagaccttataagtaagtaccaagtataccaatcgtatttaacaatactaatgacgacccatcctaccgatatatttccgataggttttgattcgtttgattatcttgtaccttatgactaccaaatcattattcagtcactatgctcagatatttagttgtattattatatattaattataacataatttttagtacttgtcaagttaattttaaaaaaaaattatagaagtaagataaaattcttacttccaattaaaattataaggatgatacacattgttattgtttaaactggaaaacaatgtaagaaaaaacagtgatgtgtaaggtatttgttttattgttaattacattatagcatatactgatacctttgtcaagttaatttaatactttttttaaaatattagttatcttttgttagttcttcctgaatagcatcccatcttctttctgcttcactacgattatcttctatatgttttgtagttttacaacatttgatacagtatatatctttgatatgaccttcttctcttttatttgctctttttcttggtactttgaatacattaccacattctttacatattaaacttgagtaaaacattttttgtcttttcataattaatcaattccttttcttgttttatttgataatttaactatatactatattgataaataagtcaacagttttctaaaaataatttaaattattttgaagaatcctttaataccaagggttacaagagaaaaagtacgtatttagaaaataaggagtactcctattatatataattatattctgatataagtaattaataatattaaatatataattataattaataaggttgggaaaattgaattaaatataatctgatacttggtaaaactactcaatatagaagtaaaatcctttagtatcagtacttacagacaaaaaagtacgtatttagaaaataaggaactctcctattatagttatatatacttattaattattattaattactatctaaatatataattataattaataaggttagagagtcaacaaaaagacaaataaaaaagtgactacttaaagtcacttgttaatttaaaaaactattttaaatgattcaatcattcttgggttaatataaattaaactagaactagcatcttcagttgtattaacttttattgatgctgaatcagaaccactaatcatatagtctatatcttttctagtgtaacccttttcgtcagatgatactaaaaaatatttagcaccacttaacattgttatttcaatatgttttgacatctacaatctctcctatgcaaatttgttaaagacaaaggatagtatagcacctagaacgagtaaaagaaccttctcagtagtatccttcttcctagtatctttagtttttgtactttcagcaagttctgaaatcttttcatcaagtctttctaattggacgtaaattgctgattgtttttcactattgacagctacatctttatctatactaactatcatttttcttagttcagctacctcaacttctaaatctttgaaagttcctctatctatataattaccttcttgtatcttagacttaatagtttctacttgagaaacaaggttgtttatctccttatccaactagaatcacctctaaggtctaaccgtttcagattcagaatggatatcataattttctaagaaatcattgataatctccatataattatccgtaacgacttttccgtaagatgtttttgtatcaatttcaaacctaagcttaccaaaactttggaggtctaattcttttattacaatattagggtcatcagaaggaaggtaataatagtcgaagtatataattgagccatttattaatactctgtctattctatagacgtggaaatagcgtctgtctcttttaaaatgggctagtgcatctttaaactctaacttaaggatatccttatatttagtcaaagtggtaacctccttactattaatttttaaatttacttattttgtggtataatagttatgataaaggcagttattataattatattaagaataatgataataattattttttctgagaaaataagccaaatactaaaaacagataaagcatagatagctgatagatatactatattaagagttaccttacttttatcttctttatagatagaataacctaaagacgttgtaacaccactaagtataaaataatagaaacaaaaaagaggtatagacagaaaaaaagatacgataatcattgttaaacacctatttctttttgacctattatttatagaacttttagattacaccactaatataacattaaaagccagtcataaaagtcaattgttagattaataatataataaaaaaagacaataggaggttaaagtggttgaataataacatagctatattcatattcaaaacactggttatcattatattcttactactaattttgtctgttattaattccttgtcccttatttattcaataagaccgagtgtagttatgacatactttatatttggtggtattgtttctaatgtcgcacttactataacagataagttcttactgaagaaagaagaccccctacctgaatatgttcttaaaaaagtagagataaatgataaagaaataagaataatcaagaaaatcatagaaagtaactacggtataacagcagaagagataaaagttagggctaaagcacaaagaagaatagaggaagatagtaaaaaggaagattacgatgaaaacaaagaaagaaattaaagaacaaaggaaagagcttaaggatggtgctacatctgtttctttagtaaaaaaaggagataagagaatagctagccctagtagaatttgtagcctatgcggtcagcagttatcaggtatgaattacactaaaggaaaagcattatcaaaagttaatcattttcatttacagtattctaagtatatttattttgatatttgcgcagatatcaacaattgttataagaatttaagaaaaagaggtgaaatggattgagtgcagaaaatattagagatataattaacaagaaaaagttagaagaagaggatacaagaaaatatatagctgatggatttatgaatggtataggtaaattaatgtatgaattcaataaaaaagtagataataaagaaatagaagttaaagaccctaatgatttatataaactattcgtgatattctctcaaatgcaaaatatggttaatgaaacttctgaaggtggagcaatacctcagctatctagacctcagcaagaattatttgacgagattacaacagaagatagtaatggagaatctacagttgatttacagaagatacaagaaatgacagcagaagatattacagcaatgatttctgaaaaagaaaaagtaatgaatgaggaaaattcagaaacattctaaggagaaagatataaatggatggaaaagaactaattaagatagcacaagaaacatttcaaactgaaaaaataacaagagaacagatagaccatataatcaatatgttaaacccttctacctatatgcttaagtatcacacactaagaggacaccctataactttcagcattcctaatagagatagaagtaaagcacaggctcatagaccatggcaaactaggattgtaaacgatactcatcctaataaggctgtaataaaatcacgtcagttaggtcttagtgagatgggtgtaatggaaatggttcattttgcagatatgcatagttatgccaatgcaaagtgtttatacacattccctacaaatgaacaaatgaaaaaatttgttcagtctcgtttgaaccctgtattagaaaaagaatattttagagatattgttgattgggataaagactctttaggttttaaaaagataagaaactctagtttattctttagaacaagttctaaagcaagtactgtagagggtgtggatattgactacttatccttagatgagtatgatagggtaaacttattagcagagtcatctgcattagagtcaatgtcttcatcaccttttaagattgtgagaagatggagcacaccatctgtacccggtatgggtatacacaaattatatcaacaatctgaccaatggtattatggtcatagatgtcaacattgtgattatttaaatgaaatgagttataatgattacaaccctgataatcttgaagaaagtgggaatatgttatgtgttaaccctgaaggtgtagatgaacaggctaaaacagtacagaatggtagttaccaatttgtttgtcaaaaatgcggtaaaccactagatagatggtataatggtgagtggcattgtaagtatcctgagcgtacaaaaggtaataaaggggtacgaggatacctaataacacaaatgaacgctgtatggatttctgctgatgaattaaaagaaaaagaaatgaatacagaatctaagcaagcgttttacaattatattttgggttatccatttgaagatgttaaactgagagttaatgaagaagacgtttatggtaacaaatcacctattgcagaaacacaattaatgaaacgagatagatattctcatatagctattggtatagattggggaaatactcattggataactgttcatggtatgttacctaatggtaaggtagacttaatacgattattctctgttaaaaagatgacaagacctgatttagttgaagcagatttagaaaaaatcatttgggaaatatctaagtacgaccctgatattataattgcagataacggagattcaggaaacaatgttctaaaactcattaatcattttggaaaagataaagtatttggatgtacgtataaatcttctcctaagtctacaggacagttgagacctgaatttaatgagaacaataatagggttacagtagataaattaatgcagaataaaagatatatacaagcacttaagacaaaggatataagtgtttatagtacagtagatgatgatttaaaaactttcttaaaacattggcaaaatgttgttattatggatgaagaagatgaaaaaactggagaaatgtatcaagttattaaacgtaaaggtgacgaccattatgcacaagcaagtgtttatgcctatataggattaacaagaataaaagaacttcttaaagaaggaaatggtacaagctttggttctacatttgtttctactgattacaaccaagaaggaaataaacaattctactttgatgaatagaggtgaaatagacttgacagataaattattttatggtacaattagtaatgaagaaattaataaaagtgtattgaatttgttattaggtgaggaattatctttagattatgtttctaaaaatagtgataccttagatgttaaatatgaacatgtttataaatctctaggattcgataatttctttgattgttttttatatgctaatagagaacctgaaatagtccataaaggtggagataaaaatcttggtgggctaaataaggttaaacgtactgttattcgtaatggtaaagaaatggaaatgacagtttacgaagacggtaataaagaaaatgatagtaaagaaaaacaagaaggcaaagaagaagttagtagaagtgcagtaggagcaagagctatttctaatggtgaagaaggaaaggtaaaccctaaaaaggtagcaaattcattatctagtttaagtaaaaaaggtgtcgatgtatcacatgttagtacaaactcatcattgtacaaagagtttgttgatgataatggggatacattaggaattacatcttttaaaagaactgaaaatgatataatattagaatcttatgcaagttcacccgattcagatggtgtaggggctagagctattatggaactattacgtttaagtattaaggaaaataaaaatgcagttgtgtatgacatagaattgcctgaagctatagagtatttaaaaactttaggatttaaacctaataaagatggatacatcttaagaaaaaaagatgtaaaacaattcttaggtgattatagtgattttatttagcactgtagtcatctattctattgtatttattctctatattatattaaaaacaatttatgtaaagtctaatatgaatagaatagataacacaactgaattattaaaaatattacaggaagatattgaaggaaagataaaaaaggaaggaagaaataaatgactttagaagaaaataaattaacattagaagaatcaataactccacttagtaaagaggagaaagaggatagtattaaagaatttagtagtttattatgtgaaatggtaaatagattatacaagtcttacaatgtatttagacaagaccctatggatgaaacgcaacgtttagatggttctctaatggtctttcaaagtagactaaatgaccctttaacaggagatttacatgacaagatgtataaacttgctttttcaaaacgcattgatatttttgaagctaacaagcaattcagaaaagatgtagaatcaggtaaggcaattgaactaggtgatgtagctattatagatacagcattaagtaatattctttcaggtaacgagttccaaggaagtatttcgtttatgcttagaaaagactttgaagaaaaagaaagaattagaaaagaagaagaagagaaacttaataacttataaaagggaagaattatgagactatataaaatgaggtatcataattgaaaaagaaaccacaaggcaatgagataatcataaccataataacggttatgatagcaatatttgtagtcattatgaccatattttttaataaataccaagatgctaaagaagataaagatagatatcagagattagttgagatttataaaaaagcagatgataatgatggagagactaaaaagaaatacgtaaaaagattaaataaagctgaagaagaacttaaaaaagtaaagaaagaaacaaattataaagactataataagaagtcaaataaagaaagacaaaaggaagataaagaaactagagagaaaatatatgatgtaactggtgatgatgacttaatattagtaaaaaataatattgagtttagtgataaggtagataaacctgaaatacttattagtgaagatggaattggtacgataactgtccctacaaacagtggttatgaaaaacaaacagtaggttctattattactagtgtattaggttccccgttcttatcaactgattcacccggtatagatagtttaggtatcattaatagtaatgtttatccaaatacagtagatagtatagtagaagatacaaatacttctactgataatgtactaaaggataatcctattataacaaatccagttgaaccaaccacaccttcagatatattacctcctattgataatccgtcagttcctatattacctgaaaatcctgtagacaataattcaggaaatatagataatacggataatccaaaccctccacctccaggatatacagatgaagatggaggtagaggctcaggtggtggaggtaatgttgaacccccaccaacggaagaaccttcagataacggtaatacaggaggaggagattgggaagaaaaacctgacccaggagaagagccatcagataatggtaatacaggagacaatgaaggagaggtaactcctgaacctgaccctacaccttctgagcctgaacaacctaatgaaaaacctaatgagggtaatggtaatgaagaaaaaccatccgaaccatcagataatcctgatgaaaatggaggatgggaaactgagccttccgaacctgaaacaccttctgagccggacgataaggtggacgaagaggataaaaacgaagatacaacagaggataaacaacctacagaacaaccggacgataataatacagataatgaggataaaactgaagaggagtaattactcctcttttttgtttgctatattaaataagagataaatataaaaaaattgaacattacggtggtgaaaactttgataggaatgaatgttataacgtcactatcagtagtatttacctgtttaagtcttttaactttaatgatttttgttcacagtaagttctccagtaaaaacgtttttgttttgtatgtaatttatgctataataggaataggtacatacatagttttaactatgtttcaaacaacatctgtacttattaagaatgatgtaatagattccatagaaaatactgaacattatattggattcaatgaccctataattatatttactataagttttataggggcaatacttggaggaatttggtacaagatgatgaaaattattaaaaagagtaactttaaagataaaaaataaaaaagacggtgaataggttgatattctctaaagataagaaatgggatgaagcaaaagatttcatcaaaggtcaagggatgcaagataattggatagagattgtagattattatagacagataggtggaaaacacgtagctgtttttattgctttaaacaaagtaaaatacatgattctagaagcaacaaaagacaataaagtaatattagtagataaagataataatatactattagaagattatgatattgttatggaaagtaaaaaaatgttttattacattgaagaaccgttcgaggttaaaataaatatccctcgacatattagagatgtaacttataataatactgttgtattaactacagtaagagggagtagaggtgactagtaattggcagatttatttaagcaattcagattaggtaaggactatggtaataatagtaccattgctcaagttcctattgatgaaggattacaagctaacattaaaaaaatagaacaagacaataaagagtaccaagacttaactaagtctttatacggacaacaacaggcttatgcagagccatttatagaaatgatggatactaatcctgaatttagagataagagaagttacatgaagaatgaacataatttacacgatgttttgaaaaagtttggtaataatcctattcttaatgctatcatacttacacgttcaaatcaagtagctatgtattgtcaacctgcaagatactcagagaaaggtttaggttttgaggtaagattaagagacctagatgcagaaccaggtagaaaagaaaaagaagaaatgaaacgtatagaagattttattgttaatacaggtaaagataaagatgtagatagagattcgtttcaaactttctgtaagaaaattgttagagatacttatatatatgaccaagttaactttgaaaaagtatttaataagaacaataaaactagattagaaaaattcatagcagtagacccttctactattttttatgcaacagataaaaaaggtaaaattattaagggtggtaagaggtttgttcaagtagtagataaaagagtagtagctagttttacttctagagaattagctatgggtataagaaatcctagaactgaattatcttcttcagggtacggattatcagaagtagagatagctatgaaagaatttattgcttataataatactgaatcatttaacgatagatttttctcacatggtggtactacaagaggtattttacaaatacgttcagaccaacaacaatcacaacatgcattagagaacttcaagcgtgaatggaaatcaagtttatcgggtatcaatggttcatggcaaattccagtggtaatggcagacgatattaaatttgttaatatgacaccgactgctaatgatatgcaatttgagaaatggttaaattatcttattaatattatatctgctttgtatggtattgaccctgcagaaattggtttccctaatagaggaggagctacaggttctaaaggtggttctactttaaatgaggctgacccaggtaaaaaacaacaacaatctcaaaataaaggtttacaacctttacttagatttattgaagatttagttaatagacatattatatcagaatatggagataaatatacattccaattcgtaggtggagatactaagagtgctacggacaaacttaatattcttaaactagaaactcaaatatttaaaacagtcaatgaggctagagaagaacaaggtaagaaacctattgaaggtggagacattatcttagatgcttcattcttacaaggaacagcacaattacaacaagataaacaatataatgatggtaaacagaaagaacgtttacaaatgatgatgagtttactagaaggagataatgacgattcagaagaaagtcaatcaacagattctagtaatgctgataaagaaataggaacagatgcgcaaataaaaggtgacgataatgtttaccgaactcaaacatctaataaaggtcaagggagaaaaggagaaaaatcttctgactttaaacattaattaataagcctagaataaatctaggctttgtttatttttttgtaatttaattttgataaaggtaataactatgatatactatatgtaattgatattaatacataaaaaatattaatatttcacttacaagttattattgttatattattaacgtaaaagtaaataaaataacaagtggaggtgtagacacctttggaagaaataaaatttaatgcttttgtacctatggatttgaagaaatctgtatcaacagcttctgatactaatgagtattctatagtttcaggatgggctagtactccaagtatggatttacagaatgatatagttaatcctaaaggaatagatatagagtattttaagtcacaagggtacattaattatgagcatcaaagtgataaagttgtaggtatacctacagagaattgctatgtggatatagaaaaaggtttatttattgaagcaaagctatggaagaatgatgaaaatgttgttaagatgcttgatttagctgagaaattagaaaaatcaggtagtggaagacgtttaggtttttctattgaaggtgcagttaaaaaacgtaacataaatgacaatagagttattgatgaagttatgataacaggagttgcattagttaaaaatcctgctaatcctgaagcaacatgggaaagctttatgaaatcatttttaactggtcacggtacatcacctgacactcaagttgatgcaggagctttaaggaaagaagaaatagcatctagcattacaaatttagcttacgtcactaagattaaagatttaaaagagtttaatgatgtatggaatggcgttgttgaagatttgagtaaatctaatagtatgggatatgaggaatcagtccttacgttacaactagctaaaggtttatctcgtaaagatgcagaactagcagtaatggatataaacaaacaaaaactagaataggtaaggagaatacattctatgagtaaagaaatgcaaaatattttagaagagtatgataagttaaatgctcaagaggcagtttcgaaatctgtagaagatgatgaaaagaatacagtagaatctaccgaagaacaagtagcagaaacaactgaagaaccggctaaagaacctgaaaaggttactgaggaagatgctaaagaagcacaagagcaaggtgaaaaagttgaatctgaagaggtaacagaggacactgaagatgaggaagttgaaaaatcagctaaagaatcaaaagaccctgtagaccaaaaagatactaaaacagaaaataaagacaacgagaaacgtaaaaataaaaaagataaaaaagaagattctgaatctgatgatgaagacaaagatactgacgatgataaagataagaaagaagataagaaggaaaaaacttctaaatcaatttctgatgaggatatcacaacagtatttaaatctatcctaacatcttttgaaaacttaaataaggagaaagaaaactttgctactaaagacgatttaagtgaagttagtaaatctattaatgagttatcagcaaaaatttctgaaatccaatctgaagatgtttctaaatcaatagacactgatgaagaagaagctgtagaaaaatcagtaacatctacaaatggggagcaagaaaaagtagaaggttatgtttctaaatcagtagacactgaagagcaagctgaaactggtgaagcaaaatcagaagatgctgaagaagtacaagaggataacacatttaaaggattaagtcaagaagaaagaactaagttcatggattcttataaagcacaagctaaagaccctagagcttctaaacatgacttacaatcagcttatcaatcttacttgaacattaacactgaccctactaatgcatcagagaaagatattaaaactgtaaaagactttgcacaaatttaattaatgcacaaagttgtgttatattatacggtgtaactaaagaatataaatagggtacattttactgtaccctacataaaataaaaagaacacaaatgaaaggtgataaatttatatgactatcgaaaagaacctgtcagacgttcaacaaaagtacgctgaccaattccaagaagacgtagtaaagtcattccaaactggttatggaatcactcctgatacacaaattgacgcaggagctttacgtagagaaattttagatgaccaaatcacaatgttaacatggactaatgaagatttaatcttctatcgtgatatctcacgccgtcctgctcaatctacagtagtaaaatacgaccaatatttacgtcacggtaacgtaggtcactctcgtttcgttaaagaaatcggagtagcaccagtatctgacccaaatatccgtcaaaaaaccgtatcaatgaaatacgtttctgatactaaaaacatgtcaattgcatcaggtttagtaaataacattgctgacccatcacaaatccttacagaagatgctatcgcagttgttgcaaaaacaattgagtgggcttcattctacggtgatgcttcattaacttctgaagttgaaggtgaaggtttagaatttgatggtttagctaaattgattgacaaaaataacgtaattaacgctaaaggtaaccaattaactgagaaacacttaaacgaggcggctgtacgtatcggtaaaggtttcggtacagctacagatgcttacatgcctattggtgtacacgcagacttcgttaactcaatcttaggtcgtcaaatgcaattaatgcaagacaacagcggtaacgttaacactggttacagtgtaaatggtttctactcatctcgtggattcattaaattacatggttctacagtaatggaaaatgaattaatcttagatgaatcattacaaccattaccaaacgctcctcaacctgctaaagttacagctacagttgaaactaagcaaaaaggtgcttttgaagatgaagaagaccgtgcaggattatcatataaagtagtagttaactcagatgacgctcaatcagctccttctgaagaagtaacagctacagtatctaacgttgacgatggtgttaaactttcaatcagtgttaacgctatgtaccaacaacaaccacaatttgtttctatctaccgtcaaggtaaagaaacaggtatgtacttcctaatcaaacgtgtaccagttaaagatgcacaagaagatggaacaatcgtattcgtagataagaacgaaacattgcctgaaacagcagacgtattcgttggtgaaatgtcaccacaagtagttcacttattcgaattacttccaatgatgaaattaccattagctcaaattaatgcttctattacatttgcagtattatggtatggtgcattagcattacgtgctcctaaaaaatgggctcgtattaaaaacgttcgttatatcgcagtttaatagaataagaaaaactgaatacaagagaatagggataaacttagggtttatcccttttttattaaaataaacttgaagggactcaataaatatgttatactataagaaattactaaatacaaaaatggctaccatttatggtacagtagatattgacaaagatggagtagttaaaggattaactaaggaacaagaaaaagagtttgcaaatgttccaggttttgaatttgaagaagaaaagaaaactactagaaaacaatcagcttctactagtaaagaagaagaacctaaagaagaggaaaagaaagcctctactagaaaaactacaagtactactagaaaatctacagcacgtaaaacaacagccaaaaaagatgaaaataagtaaagggtgaattaaatggttaactcaatgtttggaggggacttagacccttatgaaaaatcattaaactatgaatatccttatcatcctagtggtaatcctaaacatatagacgtaagtgagatagataacttaacattagctgattatggatggtcacctgatgcagttaaagcttatatgtttggtattgtagtacaaaaccctgatacaggacagcccatgggtgatgagttttataaccatatattagaaagagcagtaggtaaagctgagagagcgctagatatttctatactacctgatactcaacatgagatgagagattatcatgagacagagtttaatagttatatgtttgtacatgcttacagaaaacctatattacaggtagagaacttacagctacaatttaatggtagacctatatataaataccctgctaactggtggaaagtagagcatttagcaggtcatgttcaattgttccctacagcacttatgcaaacaggacaatcaatgtcatatgatgctgtattcaatggataccctcaattagcaggtgtatacccaccatcaggagcaacctttgcacctcaaatgatacgactagaatacgtatcaggtatgcttccacgtaaaaaagcaggtagaaataaaccttgggagatgcctcctgagttagaacagctagttataaaatatgcattgaaagaaatataccaagtatggggtaacttaatcattggtgccggtattgctaataaaacattagaagtagacggtatcacagaaacaataggaactactcaatcagctatgtatggtggagctagtgctcagatacttcaaataaatgaagatataaaagaactattggatggtttaagagcttactttggatataatatgataggattataaggagggttagaaaatggaaaaaccgtatatgataggagccaactctaaccctaatattattaataagtcaacaacatacactactacaacacaagcagatgaacaggataaacctaagtatactactaggctagagtttgatactattgatatgattaggtttattaatgataggggtataaaagtactatgggaagaagcatatttttgtccgtgtcttaatcctgacacaggtcatcctagagtagattgtcctagatgtcatggtaaaggtattgcttatttacctcctaaagagactataatggcaatacagtcccaagagaaaggaactaaccaattagatatagggatattagatacaggtactgcaataggtacaactcaattagaaaagagaatatcctatagagataggtttactgttcctgaagtattaatgcctcaacaaatgatttattttgtaaataaagatagaattaaaaaaggtataccattatactacgatgtaaaagaagtaacttatatagccactcaagatggtacagtctatgaagaagattatgaaattaagaataatagattgtatttaaatgaaaaatatgagaaccatacagtaactttaaagatacttatgactttaagatatgtagtatcagatatactaaaggaaagtcgttatcaatatactaaatttaatcaacctaaatcaaaatttgaaaacttacctcaaaaattacttcttaaaagggaagatgttattgtactacaagacccttataaagttaatgatggtatagaagaagacctagaaattcaagtagatgaccctaaagcttccgcatctaatcctagtaatttaggtggattcttcggaggtgcatttaaataatgccagttcacggaaagagacctaatttatttaaaaataaaaactataagcaggtaggtaagagaaccattgatggcatgcgttcagaagttcttgacaagctacaagcaacagcacagcaagtagagaatactagtattaaacgtatgcctacttatctacaagtaacagagaaaaagcttgaaaaagaaggagtagtagaccttaaaaaagcatttgctcactcatctaaaaagaaaactagtaaagacggaggatggtatttaactgtaccaatccgcattaaaactagtagaatgaacaacagtacttatcaagatatgaggactttaaaagtagataaaggcacaggttcagtttctaagataactgattatctagaaggacgtagaaagaatgtaagtcacccgtcaatgaaaccggaacctatgactcataacatgactaaagttaaaagaggaaagcaatcttcttactttatatttagaactgtttctagtaaatcacctgctagttcctggatacttaatagagataaagttaatgagaataatttctctaaaacaactctaaaaactgttaagcaactaatgaactggaagatgaaaaatttaaattaagaggagggttagtattaaatggcaataacatcagttgattcatatttattatcagaaataaagcctagacttaacactgtgctagagaattgttatattatagatgaagttttaaaagactttgattatcaaactagagagagctttaaagaagctttctgcggtaagaatgcacaacatgaagtaacggtaggatttaacttcccaaaatttaaaaataactatgaagctcattacttgatacaattaggtcaaggacaagagacaaaaaactctttagggagtattcagtcatcttactttgaggcaacaggagataccttagtcgaatcttctacagcaataagagaagatgataagttagtttttactgtttctaaacctataggagaattaataaaagtagaagatatagagtttgctaaatacgataatcttcaagttgaaggtaataaggtatcatttaagtaccaaacaaatgaagattatgagaattataatgctaatattatctttactgaaaagaaaaacgactctaaaggtttagtaaaaggattcacagttgaagaacaagtaacagttgtaggtctatcatttaatgtagatgttgcacgatgtttagatgctgtattaaaaatgattttaatatctatgagagatagtatagaagagcaacaaacattccaattacagaatttgtcctttggtgatattgcaccaataatagaagacggtgactcaataatttttggtagaccgacaattattaagtacacaagttctctagacttggattatactattacacaagatattaataaactaacttttaaagaaagaaaggattggaagtaggatggctagaaaaaagacacctgaaaataacactcctaaatttaatggttatgttcatatagatacattccttgatactgcaaaaaccctttttaacatgagggattcacaagtagcaggatttaaagcttatatggaaggtagtcattatttgtttagtgagcaagaattcttaccatcattagagaagtatttaggtaggaaattagatatataataacattcagataaggagaattaaatatggcagtagaaccattcccaagaagacctattacccgtcctcatgcatctattgaagtagatacttcaggtatcggtggctcagcaggttcaagtgaaaaagtattttgcttaatcggtcaggctgaaggcggagaaccaaatacagtttatgaattacgtaactatgcacaagctaaacgtttattccgttcaggagaattacttgatgcaattgaattagcatggggttctaaccctaactatacagcaggacgtattttagctatgcgtatagaagatgctaaacctgcaacagcagaagttggcggactaaaaattacatctaaaatcttcggtaatgttgctaacaacattcaagtaggattggaaaagaacacattaagtgattcattacgtttaagagtaatattccaagatgaccgtttcaatgaggtttatgataatatcggtaatatcttcacaatcaagtataaaggagaagaagctaacgcaactttttctgtagaacatgatgaagaaactcaaaaatcaagtcgtttagtattaaaagttggagaccaagaagttaagtcatatgatttaactggcggagcttatgactatactaatgctattattacagacattaatcaattacctgatttcgaagctaaattatcacctttcggagataagaacttagaatctagtaaattagataaaattgaaaatgcagatattaaagacaaagctgtatatgttaaagcagttttcggtgacttagaaaaacaaacagcatataacggtattgtatctttcgagcaacttaatgcagaaggagaagtaccaagtaatgtagaggttgaagcaggagaagaatcagctacagtaactgctacttcacctattaaaactattgagccgttcgaattaactaagttaaaaggcggtactaacggtgaaccacctgctacatgggcagataaattagataaatttgcacatgaaggtggatactacattgttccattatcatctaaacaatcagttcatgcagaggtagcttctttcgttaaagaacgttctgacgcaggagaaccaatgagagctattgttggtggaggattcaatgaatctaaagaacaattgttcggtagacaagcatcattatctaatccacgtgtatcattagtagctaactcaggtacttttgttatggatgatggacgtaaaaaccatgtacctgcttatatggtagctgtagctttaggtggtcttgcaagtggtttagaaatcggtgaatcaatcacattcaaaccattacgtgtaagttcattagaccaaatctatgaatcaatagacttagatgaattaaatgaaaatggtattattagtatagagtttgttcgtaaccgtactaatacattcttcagaatcgttgatgacgtaactacattcaatgataaatcagacccagttaaggctgaaatggctgttggggaagctaatgacttcttagtaagtgagcttaaagttcaacttgaagaccaatttattggtactcgtactatcaatacaagtgcttcaattattaaagactttatccaatcttacttgggtcgtaagaaacgtgataatgaaattcaagacttccctgctgaagacgtacaagttattgttgaaggtaacgaagcaagaatttcaatgacagtttacccaatcagaagcttcaagaaaatctctgttagcttggtttacaagcaacagacattacaagcctaatctaggtgatggagtacctggattaggtactcctattaatataatttgaatactttaggagagtgaatacagatggcatcagaagctaaacaaaccgtccatactggtaataccgtcctacttatgattaaaggtaaaccggtaggaagagcacaatcagcatcaggtcaacgtgaatacggtacaactggtgtatacgaaatcggttctatcatgcctcaagaacacgtatacttacgttatgaaggtacaattacagtagaacgtttacgtatgaaaaaagaaaactttgcagatttaggatatgcttcacttggtgaagaaattcttaagaaagatatcattgatattttagttgtagataacttaacgaaacaagttattatctcatatcatggttgctctgcaaataactacaatgaaacttggcagacaaatgaaattgtaacagaagaaatcgagtttagttacttaacagcaagtgacaaagcacgtacttaatatactagaccaactaaaaagttggtctttttttattgacattataaaatttatatgatattataataaacaggttaggagtaatgagtatgaataatagacaagctaaaataaaaggttataatcaatttcattattatgattttccaacaactaaaggtaagtttaaagatataatgaaaagaaagtctagaacagaacttaaaaaagatttacaaaaagagaggaaagattatcttgacaaataagagaaaaacaataggaaaaatgagtaatacgagagcaacatggaatatcaaccctgtaactaaggttaaaaaagataaaacaaaatattctagaaaaaataagcataaaggtcttgacaactataattaactaaggtatattattagtataacaaaaaaggagatgaattacatgagtacattttggtcaaaaagaagaacaacaggtaaggacagacaagtaaagaaacattatactcaaatgtctttacaagaaaagaagaagtgtgttaatctattacaagatacaattaatacgcataagtatttagaactatcaagtcattgtaaaactaaacttaaaaataaaattaattttagtaatctagtaagatttatttttaaggatagaaatgcaccatttaatattattgagtataatattacagattttcatggtaaagaacaaagaagaataatttttaaaagccctactattgtaactatagaaggagtaagtagttatcagtacttagttattaacttagaagatggtacaataataactacatactataatggtattacagatacacataaaacattagatttaaaatattataataaaaacttgacaattaaataaggaggaattataatgggattaatatttgtaaatagttattttataatatcaaacatattaattattgtgtttagtaaattaaatagtaaaaaaaaggtaacagaaaaaactctagctacaagtaatcttttattaacaatatcatatattcaactattagaatttttaatcattaatggtatttactactcattaaaatatatgtaaaaaaagtattgacagaataaaaataataaactataatacagatataacaaattaaaggagaagatataaaatgtcacaagataaattaagagcaatttacacagaaatgaaagtagaattacacaaatttcctaaagaggtagatgtaacaagtaaatcaactgcaattgcaatcaatcagattctagataaatttaaaacattaactgaacaagcagggaaaattacgagaaaatatctagaaggtcaagaaatattaactattgattatgagtattatgattcattacaagaatactatatctacctacttagaaacagtgaaaagattgaacaaagtttacaagaaatcactaagcgtacaggtgaatatgtaaagtaattttgatttaaaaacaaaatatgatatactatgtttaaagtagtaagcctacactagtccgtgttatattaatattgaatcggataagcgtaggctttattaatatttaaaaaaggaaggtatatcatattatggcagaagaaattaaaaaggaacaagatgtacaagaaacaactaaagaagataaaaaagatgttagtaaaatgacaccggaagaaatagataaattaaaatatcaagataagcaagaaaaagaacaagtaattaacaaagttattaaaggtgttaatgatacttgggaaaaagaatataactttgaagaattagatttaagatttaaagttaaaattaaattacctaatgcacgagaacaaggtaacatatttgcgttacgttctgcttacttaggtggtatggatatgtatcaaacagaccaagtaattagagcataccaaatgttagctacattacaagaagtaggtattgaagttcctaaggaattccaagaccctgatgatatctataacttatatcctttaactgttatgtatgaagattggttaggattcttaaactcctttcgttactaatagtatagaaacattagataaagatatagaacgattgggtggtatggaatcaattgttaaacaacctttatctagaaatctatgggctattatgaaagagtttaatgttttgcctactgagcaaagatttaaggatttagacgattatcaaatagagtttattattggtaatatgaatagagatgtttatgaacataataaacaacttaaacaagctcaaaaaggtggaaaattcgatagtcaatttgaagatgacgatagtagttggtggaatgaatctcatgaagactttgacccggtacctgatttcttagatgccgatgacttagcacaacagatggaagctaaattatctgatagagataaggaagaaagagctaagagaaatgatgcagagttaaatgatgaaacagaaggactcactacacaacatcttgctatgatggaatacattagaagaaaacaagaagaattagatgatgaagtaggaaatggtaaaactagtgaagatgatgctactataacacaagagagcgttaataaagcactagaagacctagatgatgactggtatatgtaaagggtggtaggtgatactaccatccttatttttttaaaatggatggtgaataatgatggcaatgaatgacgattatagattggtcttatccggtgatagttcggatttagagaatagtctgaaggcaatagaactttatatggattccctagaatctaaaaatattgatgcccctttagacaatttcttaaagaaattaaaagtaattgctaaagaagttaaaaatgtacagaactcaatggataaacaagaaggtaaatctgtcatatcttctaaagatatggatgaatctattaaatccactcaatctgctacaaagaatataaatgaattaaagaaagccttagatgaccttcaaaaagaaaatatatctaaaggtattgcacctgaccctgaagttgaaaaagcatatgctaagatgggtaaagttgtagatgaaactcaagaaaaacttgagaaaatgtcttcacaaaaaataggctcagacgctagtatacaaaatagaattaaggaaatgaaaaccttaaatcaagtaacagaagaatataataagataagtaaagattctagtgctactaaagactatactaaacgtttaagagctaatcgtaatatgactagagggtatatggagcgttcagaaggaacaggacgtttaacatatgaccaaggggcacgagttagaagtgaactaggtaagataggttcttatgaaagtcaaagaaaacaaaatcaacgcaacttaggtcaagcaagagaacaatatagtaattatagaaaccaacaacaagacctgactaaacgtagagctagtggtcaaataaataaagctcagtatgaacaagaattagcttctattaagcaggaaatgaaagctagagaagaacttatatctaactatgagaaattaggagcagagcttgataaaactgttcaatactataaaggttcagttcagaaagatttccaatctagagatgtagaccaacaacgaggaacatttggtagaatggttcaagagcgtttaccatctatcggttctcatgctatgatgggaactacagctatggctacgggtttatacatgaaaggtgcttcattaagtgaaactaatagaccaatggttacatcactaggtcaaaactcagataatatggatatagattctgtaagaaatgcatatggagacttgtcaattgataacaaattaggttataatagtactgacatgttgaaaatggctacttcatatgaagcatctgtaggacataaaagtgatgaggatacaatggcaggaactaaacaacttgctattggaggacgttctttaggtattaaagaccaagaagcttatcaagagtctatgggtcagataatgcatactggtggagtaaattccgataacatgaaggagatgcaagatgcattcctaggcgggattaaacaatcaggtatggttggtcgtcaagatgaacaacttaaagcattaggttctatagctgaacaatcaggagaaggaagaactttaactaaagaccaaatgagtaatcttactgctatgcaatctacttttgcagagtcaggaagtaaaggattacaaggtgaacaaggtgccaatgctattaatagtatagaccaaggacttaaaaatggtatgaatagttcttatgctcgtatagcaatgggatggggaacacagtaccaaggtcttgaaggtggatatgatttacaaaaacgtatggatgaaggtatatctaaccctgaaaacttgacagacatggctgatatggctactcaaatgggtggtagtgaaaaagaacaaaaatacctattcaatagaagtatgaaagaaataggtgctaacttaactatggagcaatctgatgagatatttaaagatgctcaatccggaaaattatctaaagaagagttagctaaaaaagctaagaaaatggaaaaagaaggtaaaaaagaaggagaagataacgccactgattataaagaatctaaatcaggaaaaaatgaccaaaataaatctaagactgatgataaggcagaagatacttatgatatggctcaaccattaagagatgctcatagtgctttagcagggctacctgctcctatatatttagcaataggagctattggagcatttacagcatcactaattgcatctgcaagtcaatttggggcaggtcatttaataggtaaaggagctaaaggacttagaaataaatttggcagaaataagggtggtagctccggaggtaaccctatggcaggaggaatgcctactggaggaggttcacctaaaggcggaggctctcctaaaggtggcggtactcgttctactggaggtaaaatacttgatagtgttaaaggattaggaggattcctagtcggtggagcaggatggaaaggtatgtttggtggagaatctaaaggtaaaggatttaaacaaacatctaaagaagcctggtcaggtactagaaaagtatttaacagagacaatggtagaaaagccatggataaatctaaagatatagctaaaggtactggtagcggtcttaaagatatttataatgatagtatatttggaaaagaaagaagacaaaatctaggagataaagctaaaggttttggtggaaaagctaaaggtctctatggtaaatttgctgataagtttggtgatggtggtaaaaatggtatcctttcacaatcaccaaaagcaggcggtagcgggctaggaaaactaggaaaacttgcaggtggacttggaaaaggagccggagttttaggtgttgctacatctgccttatcattgatacctgctttagcttccggtgatagtaaagctatcggcggaggtataggctctatgggcggaggaatggcaggtgcatcagcaggagcttctattggagctttatttggtggtgtaggtgcaatacctggagctttaataggcggagctataggttcttttggtggaggagctgttggtgaaaaagtcggagacatggctaagaaggctaacactaaagaaggatggaacctaggatggactaatggagataaagacggtaagaataaattccaagattctttattaggaaaacctatatctaaagcatggagcggtataacaggtctctttgataatgacgctgaagcatctgaagaagatagcaaagataagaaaaaaggcgttaaaggtgttaaaggagatactaagaagaaagaaaaaatgacagcagaacaacttagagaaaagaataaccaatctgaaactaagaatcttaaaatctatagtgatttacttgatagggctcagaaaattattgagagtgctaaaggtattaatatagatggaggaacttctgatagtggttctgatagcggaggctctgcatctgatgtaggtggagaaggcgcagagaaaatgtataagttccttaaaggaaaaggactatctgacaatcaggtaggagctgttatggggaacttacaacaagaatctaatcttgaccctaatgctaagaatgcctctagtggtgcatttggtattgctcagtggttaggggctagaaaaacaggattagaaaactttgctaaatctaaaggtaaaaaatctagtgacatggatgttcaattagattacctatggaaagagatgcagtctgattatgaaagtaataatcttaaaaatgccggatggagtaaaggcggaagcttagaacagaatacaaaagcatttgctaccggatttgaacgtatgggagcaaacgaggctatgatgggtactcgtgttaacaatgctaaagaattcaagaagaaatacggaggctccggtggcggaggaggtggaggagctctatcctctacttaccaagaagctatgagtaaccctgtattaactactggttctaactataaaggctctaatgatgcttctaatgcttctacaactaatagaataacagttaatgttaacgttcaaggtggaaataatcctgaagaaactggagacattatcggaggaagaattagagaagttctagacagcaacatggatatttttgcaaatgaacataagagaagttactagtaattttgtattgacacaagagtagtatcatagtatactactcttatacatataaaaataaaaggaagtatgtgtatatgaaaagattaagaagacctaaggtaagaatagagatagttacagatgataatacatttacattaagatttgaagatacacgtgactacaatggtgatgagttcggagctaaacttttaggtttccaaactaaaaactctatggaagatgatagttctgtattccaaatcaatatggcaggagatacttactgggataagttagttatggctaacgatataatcagaatatttattacacctaatgatgaccctaatgataaagaaggtcgtcaagaacgtttaatccaagtaggtatggtatcacaagtatcaaaagtaggtagttatggtaatgaccaaactcaatttaggataacaggtcaatcttttgtaaaaccttttatgaaatttggattaggagttattcaggaagttcaagctgtattacctgaagtaggttggcttattgatggtgacggagataatgaagtaaaatttactggtagctcagcccatgaagtaatgacaggaattatacgtagattcataccatatatgaagtataactatactgaaaaaacatataatacaattgataactatcttgattatgatgatttaagtagttgggatgaatttgaaaatttgacagaagtatctgcttttactaattttgatggctcattaaaacagttgatggatatggtaacagctagaccctttaatgaattgttcttcaaaaactctgaaaaaacacctggtaaagcacaacttgtattaagaaaaaccccttttaatcctactgagtggagagctttagatatgattaaagtacctactgaagactttattgaagaagatgtaggtaaaagtgacgtagagacatattctatatttacagctacacctgcaggtatgttaaaagaacttaatggtgatgtattttctaaaccacaatttcaccctgaattgactgatagatatgggtatactaaatttgaagtagaaaatatctatcttagtactaaatcaggttcagctactgaagactcagattcttcgggtgatgacaatggtactgaaagaggaacttactctaaaattatgaaagatttaagtaactatggaagagataatatatctaaaggtatagataagtatacaagtaaattatcttcaaaatataaaaacttaaaaaaagctcaagctaaaaaaattatagagaaatttgtcaaagaaggaaaagtaacagaaaaagaatacgagaagataacaggtaataaagtagatgatgaattaacatcagataacagaccgaagttgacaaaggataaattaaagagtatactaaaagagaagtttaaaacacaagatgattttaataactctaagaaaaagaaaaaagctaagacagatgcacttaaagaattgacaactaaatatcgtttcggtaacaaaacacacgctacaactttgttagatgaatatattaaatacaaaggagaaccaccgaatgatgaagcttttgataaatatcttaaagctattgaaggtgttagtaacgtagctacagacacaggttcagatgcaagtgatagtcctttagttatgttctctagaatgctatttaattggtatcatgggaaccctaacttctacgcaggagatattattgttttaggagaccctaagtatgacctaggtaaaaggttatttattgaggataaacaacggggagatacttgggaattctatattgagtctgtagaacataaatttgattataaacaaggttattatacaactgtaggagtaactagaggtttaaaagatgctatcctagaagatggtaagggtagtcctcataggtttgcaggtttatggaatcaatcatcagacttcatgggaggtcttatgggtgaagatacttctaaagaactcaaagaaaaaggtgtagcagagaagaaaagtagtggagataaagacggtggctctgatagtggtggagcacaagatggaggttctctagattcacttaaaaaatataatggtaaacttcctaaacatgacccaagtttcgttcagcccggtaaccgacattacaagtatcaatgtacttggtatgcttataatagaagaggtcaattaggcattcctgtgcctttatggggggatgccgccgactggattggtggtgctaaaagtgcaggatatggagtaggtaagacaccaaaacaaggtgcctgtgttatttggcaacgaggagacaaaggtggttctaatgcttatggtcacgttgcctttgtggaaaaagttttagatggtgggaagaaaatattcatttctgaacataactgggctacgcctaatggttatggtactagaacaatagacatgagctctcaaataggtaaagaagctcaattcatttacgataagaaataaaggaggatagtctatggcaacagataaagaagctaaagatgttattgataaatttatagataatgtgtttaattttgatgtattaactacggaaagagttaaagaaaaagatgaagaaatcaaaaaaataactacagatgatatgtatgaaaaagttgtgtatatacgaccttatgttggagtaatacaaagtcttaaccctcaacatgtacaatatgaatcattttctaataatggttacgatatagaagcagaattaagttttaggaaagtaagttatttagttgataaagggtctatacctacagattctttatccactttaacagttcacttagtagaaagaaatcaggagttattaatagattactttgatgagatacaagatgtgttgtatggggagtatatggaagaagaatatgtatttgatgaagatgtaccattaagtactatactagcattagacttaaatgataatcttaaatccttatcaaatataaagtatatgttcaaaggagcccctaaagataatccttttggaacagataaagatgtttatatagatacttataatttattatattggttgtatttaggtgaagatgaagaattagcatatcctatgaatattaactatttctttacagaaggtagattttttactgtttttggtaaaggtcataagtataaagtagatgttagtaaatttatagttggagatatattattctttggtagaagtgatactaatataggtatttatgtaggtgatggagagtttatatctatgataggtaaatttccaaaagatgagacacctataggaaaatacaaacttgatgattactggaatgaatttaacggaagagttatgagattcgatgaagaggtgtatatttaatggtagtaagattccaatcttccatggggagaagtctaaaaagagtagattcagatgacttaaatgtaaaagggttagttttagctacagttagtaaaattaattataagtatcaatcagtagaagttaaagttaataacttgactttaggaagccgtataggtgatgatggtagcttagctgtaccttatcctaaatctttcataggtagaacacctgagggaagcgtattcggtacaaaaccacttattactgaaggttctgtagtattaatagggttcctaaatgatgatataaatagtcctataatcttgagtgtttatggtgataatgaacaaaataaaatgattaatactaaccccttagatggaggtaagtttgatacagaaagtgtttacaaatacagtagttcactatatgaaattttaccatctttaaattataaatatgatgatggagaagggacaagtattagaacttataatggtaaatcattcttctctatgacatcaggtgaagaagagaaaccgcaggcaacagatttttatactggaactgagtatcaagatttatttacttcctattatggtaataaaacattgattgaacctagaatacaaaaggctcctaatatgttattcaaacatcaaggagttttttatgatgatggcacgccggataatcacataactactttatttatatctgaaagaggagatatcagagcttcagttttaaatacagaaacacagaaaagaactacacaagaaatgtcaagtgatggttcttatagggttattaaacaggatgacgatttaatgttggatgaggctcaagtttggattgaatatggtattagtgaagataataaattttatattaaaaatgataagcataaatttgaatttactgatgaaggaatttatatagacgataagcctatgctagaaaatttagatgagagtatagcagaggctatgaagaatttaaatgaaatacaaaaagaactagatgatataaactatcttcttgagggtgtaggtaaggataatttagaagaactaatagaatccacaaaagagtctatagaagcgtctaaaaaagcaacttcagatgttaatagacttacaactcagatatcagaggttagtggtagaactgagggtattataactcaattccaaaaatttagagatgagacttttaaagacttttatgaagatgcttctactgttattaatgaagtaaatcagaatttccctagtatgaaaacagatgttaataatctaaaaactaaagttaataacttagagaaaactgagataccaaatatcaaaaataggttaacagaactagagaataataataacaatgcagataaaataatttcagatagaggagagcatataggtgctatgatacagttagaggaaaatgttactgtaccaatgagaaaatatatgccaataccttggagtaaagttacttataataatgctgagttttgggattctaataaccctactagattagtagtacctaagggaataacaaaagtaagagttgcaggtaatgtcctatgggattctaacgctacaggacaacgtatgttgagaatattgaaaaatggtacttatagtttagggttaccttatacaagggatgtagctatatctaccgcacctcagaatggtactagtggagttattcctgttaaagaaggagactactttgagtttgaggcttttcaagattcagaaggtgacagacaattcagagcagacccttatacatggtttagtattgaagctatagaattagaaactgaaaccatggagaaagactttatgcttataggtcataggggagcaactggatatacagatgaacatacaataaaagggtatcaaatggctttagataaaggtgcagattatatagaattggatttacaattaacaaaagataataagttattgtgtatgcatgattctactatagatagaacaacaacaggaacaggtaaggtaggggatatgactttatcttatatacaaactaactttacatctcttaatggtgagcctataccatctcttgatgatgtattaaatcattttggaacaaaagttaaatactatatagaaactaaacgtccttttgatgctaatatggataaagaattattaactcagttaaaatcaaaaggattaataggaattggttcagaaagattccaagtaattattcaatcatttgctagggaatcattaattaatattcataaccaattttctaatatacctttagcttatttaacaagtacattctctgaaagtgaaatggatgattgtttaagttatggttcttatgctattgctcctaaatatacaacgataactaaagagttagtagatttagcgcatagcaaagggcttaaagtacatgcatggacggtaaatacaaaagaagaaatgcaaagtttaatacaaatgggtgtagatggattctttacaaattacctagatgaatataaaaagatttaatattaaagacctattaatttaggtctttttttagttgtaatttaaactagttcgtgatatattagtagtatgagatttatatacatactgaaaaggagaggataaaatgccacaatcagatggaataagtaatcttcatagaatagctttacgcttccctaaagaaggcggtggttatgatatgtataggtttaaagttaatcctgagaattacacaatagattcaccacaacgtacgacagcaattaaaacaaaatcagatattgtaatagaagattatggtaaagacatagaagttattaacttcacaggtacaactggttttagacctgttagagaagcagatggattaaaaacaggtaagcagaagatggaagagttacagagtagagttagtgaatatgctatgcaaggtggtagtggtaacgtaagtggctcttatttacaattttttaactttacagatgatagctactataaagttcatttagcccctcaagggttaaaggtaactaggtctaaggatgaaccgttactttttagatatgaaataacattagtagtcatcggttcattaacagaagcagatagaagtgctgtaacaacagaagagtttggtaatgttaaacctaacgcttctcaaagagtagatgaaggcataaaagaactagataaaaatgctcgtaaaacgagagatagaaataaccaagaaatatctagaagagaaaatacaatacctaaatctacaggagataatacaaacgagggtaataggttaaagcaaagtttccctagtagttctatatataatcctagacaatctactaatggattaaaaggtaatattgacaatatggctttaataatcggttatggtgatggaggtgtatctagctaatgaataattttataccacaacctcaagggttacttaggtttttaaacgccctagatacagatttaacttcttctcatatgaatttacttgatgaagaggtatcatttgtatctaaattttatacaccgcaattacaattaagtgaattagcaaaaaaagtattgacaaatataaagacagatgatatacctgtattagaaagagaatttaatgacaatacaattattcataaagctaacgatacattactaaaagtacaagcccctagaatgtatatgattctacaatctattgtacttgaagcgtatgctattgttaattgctttgtagaaaatccaagttctttaaaatatctaactgaagaagatgttagaataacacgagaaaatttaaattatgtagcagactatttaggtaactatgatgattacaatagtgttgtcttagatttacgagacctagatttatgttttagtgctatagagttacaattacctctaattaaaaaggaggctaacgtataatgagatttaagaagcatgttgttcaacatgaagaaactatgcaagcaatagcacagagatactatggtgatgttagttattggatagacctagtagaacataataacttaaagtatccttacctagtagaaactgatgaagaaaaaatgaaagaccctgaaaggctagcttctacaggtgatacattgattatacctattgaatcagacttaacagatgtatcagcaaaggaaattaattctagagataaagatgtattagttgagttagctttaggaagagatttaaatattactgcagatgaaaagtattttaatgaacacggtactagtgataacatactggcatttagtacaaatggtaatggggatttagatactgtaaaaggcatagataatatgaaacagcagttacaagcacgtttattaactcctagaggttctttaatgttacaccctaactatggctcagatttgcataatttatttggtcttaatatacctgaacaagctacattaatagaaatggaagtattgagaacattaacatcagataatagagtaaaatctgctaatctaattgattggaaaatacaaggtaatgtttattcaggtcaattttcagtggaaataaaatctgttgaagaatcaataaattttgttttaggacaagatgaggaaggaatttttgctttatttgaataggaaaggattaaattatgaaaactagaaaattaactaacatattatcaaaattaatagataagacaatggcaggtacaagtaagataacagattttacccctggttcagcctctaggtcattattagaagctgtatcattagagatagagcaattttatatcttgacaaaagaaaatattgattggggtatacaagaaggtattattgaagcttttgatttccaaaagagacaatctaaaagagcttatggtgatgttatcattcaattttatcaacctttagatatgagaatgtatatacctgcaggaacaacttttacttcaacacgacaagaataccctcagcaatttgaaacattagttgattattatgcagagcctgactctactgagattgttgttgaggtttattgtaaagaaacaggagttgcaggtaatgttcctgaaggaacaattaatactatagcatcaggttctagtttgattagaagtgttaataatgagtattcttttaatacaggaactaaagaagaaagccaagaagactttaaacgtagatttcactcttttgtagaatctagaggtagagcaactaataaatcggtaagatatggagcattgcagatacctgatgtagaaggtgtttatgtttatgaagaaacaggacatattacagtatttgcacatgatagaaatggtaatttatcagatactttaaaagaagatataattgatgctttacaagactatagaccgagtggtataatgttagatgttacaggtgtagaaaaagaagaagttaatgtttctgctacagtaactatatctaataaatctagaattggtgatacattgcaaaaacatattgaaggtgttattagaagctacttaaataatttaaaaacttctgatgacctgataattacagaccttattcaagctataatgaatattgatgatgtattaatatatgatgtatcgtttgagaacttagatgagaacattatagtaccaccacaaggaattattagagcaggagaaataaaagtagaattaaagtaaagagaggtgaaacttaagtcgtggctaattttttaaagaatcttcatccattattaagaagagatagaaataaaaaagataatcaagaccctaactttgctctgatagatgcactcaatgaagagatgaatcaagtagagaaagatgctatagaaagcaagttacaatcttctctaaagacagcaacgagtgaatatttagacaaatttggagattggtttggggtttatagaaagaccgatgaaaaagatgatgtttatagagcaagaattataaaatacttactcttgaaaagaggaactaacaatgctataatagatgctataagagattatttaggtaaggatgatattgatgtaagcgtgtatgaaccctttaccaatattttctatactaacaaatcatacttaaatggtgaagaccatttaatgggatactattatagatttgctgttataaatgtttctataggtgactatttccctatagagattatagatgtaattaacgaatttaaacctgcaggtgtaacattatatgttacttatgatggagcttctactatcagaggtggagcaattattaagtggttagatggactacctaaaattgaaacatatcaagagtttgataggtttacaggttatgatgatacattttatggtcatattaatatgaatcaaagtaaagatactgataatagttcatcagacatttttaaaacaaatcatagtttaattaatagtttagatgttttaacaggttcctctagtgtaggtagacaatatgttaactatggatatgtaacatcatatgtttataatccaggtatgacatcttctgtaaaccaaataagtgctagtacagaaggtagaggtcaggaagtacctactgattattatatgtatactagtaccaagaataataatacagtagaacttaatatgcaaactacttccggtgtatcttatctctataataactttaattttagagattatatgagtaagtatagacctcaagtagatttacaatctgatgaggctagaagaattgtatctgattatataaaagaattaagtattgattattatctcagtgctgttatacctcctgacgaaagtatagaaattaaattacaagtttatgacttttctattaatagatggcttacagtatcaattagtaacttatctttctatgaaaaaaatattggtagcaatataggttatataaaagattatttaaatagtgaattaaatatgtttactagattagagataaatgcaggtaaaagagactcagtagatattaaagttaactatctagatttaatgttttattactatgaacgaggaatttacacaataaaaccttataaagcattagtagaaaattacttagatatatctagagagacttatgtagaggcgtttaaaatagcatcattattgaatggagacattataactaaaacaggtttccaacctataggatacttaaaattagttggtagttatgagaatacaagacctagcgcagtaaacatagtagctaaagatacagataataatcctatagaatctactgagttagatgtgtatagtacaatagaaaacaggaatctattacagtcttataaaggtgtaaataatatagctagagaaataacatctacggaagagtttaccgtatcaggatgggctaaagagatatattcaactaattatttgtctaaagtactaaaaccaggtaaagtatacactttatctttcgatatggaaataacaaataatgacctgactcttaaatcttattctgataatcatggtatatatttatacagtaataccaaaggaattgttgttaatggtgttaaatctatggagcgcaccgtaggtaacaaagtatctataactcagacttttacagcacctactattaccgaccacaggttattaatttatactggaagatatacatctgatgggaaagcatcaacccctccagtgttctttaatacagttaaaattactgaactaaaattatctgaaggtgactctaaattagcttactcacctgcccctgaagataaacctaatgtaatagaaaaaggaattcaatttaataatatcaaaactaatatacagactttaaatatcaattcagatattaatctaaagaatgtaactttatactattcttactatggtgatagttgggtagaattaaaaactataggtaatattagtacaggagaaacaacagaaactaataatttaatagatttatatggattacagacagtagattactctaacataaatccaatgtcaaaagtatcattacgttctatttggaatgttaaattaggtgaacttaataatcaagaaggttctttatctaatatgcctaatgattattttaatgctgtatggcaagacatagataaactatcagatattgatttaggttctatgagaatggtcaaagacactgaaggtggagtatttgatggagctacaggtgaaattattaaggctactttatttaacgttggtgtttatactgatttagatatgttagcttatactttgactaattacactgaaccattaactttaggttctagtagattgataagtgagctaaaagaagaattactaacatcagaatcatttaatgttgataatagaattaaagtaattgactcaatctctgagcaattacctaataataatatattgagtaactcttatcaaacacaaacgattacacagaatggatttgctaaatataatttgaaagaacctatagaacaaagaaaacaatacaacctaagaatacatggagattttaaagaaggactagaaagattagctataggtaattctaatgggtcatttaatgaagtatttgtttatcctgaaaatattaaagatggtatagtagatattacttatacttctagagatgataattatgcagaaggaaaacaaagacttaataatgattatagagtttatgctcaaccatatgatagtggtgtagttacaatttacagtctagagttaataaaagtttaataaataagttgacagaaagttaataatatggtatacttataaagtaatatttagtgggtataccatgttatattaataaagaaaacaacagatgaaaggaattaaaaaatatggcaattgcaacgtataattctcatgttgagttagcaaaatatctagttagtaaagctgattcagtttacttaacaattggaaagagcacaccgtggtctaatgaaacaaacccaccgcaacctgatgaaaatgcaacagtattacaggaggttattggatacaaaaaagctactaaagttactttagttagaccttctaaatcacctgaagatgataataagaatttaatttcttatggtaataaatcgtgggtagaagtaacacctgaaaatgctaaggctgaaggagctaaatgggtttatttagaaagtagtattgttggtgacgaactacctcttggaacatatagacaagtaggatttgttatggacttagtagcaaaaagtggtattagtaaatttaacttagtaccgagtgaagtagaatcaattggaacactattattctttgacaataaacagttccaaaatagaagtgagcaaacaactgctaaagaaagatttattgtagaagtttaaagaaagggagataattctaaatggcaattaattttaaaggttcaccttatttagatagatttgacccgtctaaagatagaacaaaagtattatttaatcctgatagacctctacaacaggcagaattaaatgaaatgcagtctatagaccaatattatttaaaaaatctaggagacgctatttttaaagacggagataagcaatcaggacttggattcacattgtctgaagataatgtattgacagtaaaccctggttatgtatatatcaacggtaaaataagatattacgataatgatgattcagttaaaataactggtgtaggtaaagaaactatcggtattaagttaacagaacgtattgttacacctgatgaagatgctagcctattagaccaaactagtggggtaccaagttacttctccaaaggtgcagatagattagaagaaaagatgtcattaacagttaatgaccctacttcagcaactatttatactttcatggatggagatttatatatccaatcaactaatgctgaaatggataaaatcaataaagtattagctgaacgtacttacgatgagtcaggttcatataaagtaaatggttttgagttattctcagaaggtaacgctgaggatgatgaccacgtttctgtagttgtagatgcaggtaaagcatacgtaaaaggttttaaagtagataaaccagtatcaacaagaattagtgtacctaaatcttatgacctaggaacagcagaaaacgaaagtactatatttaataagtctaataattctattagtttagctaatagccctgtaaaagaaattagacgtgttacaggtcaagtacttattgaaaaagaacgagttacaagaggagctcaaggtgatggtcaagactttctttcaaataacacagcatttgaaattgtaaaagtttggactgaaacaagtcctggagttactacaaaagagtataaacaaggagaagacttcagattaacagatggtcaaactattgactggtcacctcaaggtcaagaaccttcaggcggtacctcatactatgtttcttataaatataataaacgtatggaagccggtaaagattatgaagtaacaacacagggtgaagggttaagtaagaaatggtacattaactttacaccttcaaatggagctaaacctattgaccaaacagtagtattagtagactatacttactacctggctcgtaaagattcagtgtttattaataagtatggtgatattgcaatactacctggtgaacctaatattatgagattagtgacaccaccgttaaatacagaccctgagaatttacaattaggtacggttacagtattacctgattcagatgaagcagtatgtatttcgtttgcaatcactagattgtctatggaagacttacagaaagttaaaacaagagtagataacttagagtataaccaagcagtaaatgctctagatgatggtgctatggaaggacagaaccctttaacgctacgttcagtatttagtgaaggtttcattagtcttgacaaagcagatattacacatcctgacttcggaattgtatttagttttgaagacgcagaagctactctagcgtatacagaagcagttaaccaacctaagattattactggagatacaacagctcatatttggggtagattaatttcagcaccatttactgaggaacgtacaatctatcaaggtcaagcatcagaaacattaaatgttaacccttataatatccctaataaacaaggtgtacttaagttaacacctagtgaggataactggattgatactgaaaatgttacaataactgaacaaaaaactaagaaagtaactatgaaacgattttggagacacaacgaaagttactatggtgagactgaacattacttgtattctaatttacaattagatgcaggacaaaagtggaaaggtgaaacttacgcttacgatagagagcatggacgtactggtactttattagaatcaggaggacagcgtactctagaagaaatgattgaattcattagaattagagatgtatccttcgaggttaaaggtctaaaccctaatgataataacttatatttattatttgatggtgtaagatgccctattacccctgcaactggttacagaaaaggttctgaagatggaactattatgacagatgcaaaaggaacagctaaaggtaaatttactattcctgcaggtattcgttgtggtaaccgagaagttacactcaagaatgctaactctacaagtgctacaacttacacagctcaaggacgtaaaaaaatcgttcaagatattattattagaactcgtgtaacagtaaacttagtagacccattagcacaatcattccagtatgatgagaacagaactatatcatcactagggttatactttgcttctaaaggtgataaacaatctaacgttgttatccaaattagaggtatgggtgaccaaggttatcctaataaaacaatctatgcagagacagttatgaatgcagatgacattaaagtatctaataatgctagtgctgaaactagagtatactttgatgaccctatgatggctgaaggcggtaaagaatacgctattgttattattactgagaacagtgattatacaatgtgggtaggtactagaactaagcctaagattgataaacctaatgaggttatctcaggtaacccatatcttcaaggtgtgttattcagttcatcaaacgcatcaacatggactcctcatcaaaactctgaccttaaatttggtatctatacttctaaatttaatgaaacagcaacaattgaattcgaaccaattaaagatgtatctgcagatagaatcgttcttatgtctacgtacttaactcctgagagaacaggatgtacatgggaaatgaaattaattctagatgatatggcatcttctacaacattcgaccagttgaaatgggagcctatcggtaactatcaagacttagatgttttaggtctagcaagacaagttaaactaagagcaacttttgaatcaaatagatatatctcaccattaatgagttctagtgatttaacattcactacattcttaacagaattaacaggttcatatgttggtagagctattgatatgacagaggctccttacaatacaataagatttagttatgaagctttcttacctaaaggtactaaagttgttcctaagtattctgcagacgatggaaaaacttggaaaacatttactaaatcccctacaactactagagccaataatgagtttacacgctatgtcattgacgagaaagtaaaatcatcaggaacaaatactaaactacaagttagattagatttatcaactgaaaatagctttttacgtcctcgtgttcgtagacttatggttactactagggatgaataaactagaggggttgattgacccctctttatttaataaggagagatttatatgcctagagaagttagagacccttattctcaagctaagctatttatacctacagttgaagaaaaatcaattaaggaattagaaagaacatataaggaaaaaattaatgaagttgatagacttcttaatgaattaaagaaagagagaggagaaaaatagatggcatttaattacacgcctcttactgaaacacaaaagttaaaagatatgtacccgaaggtaaatgatattggtaactttttaaaaacagaggttaaccttagtgatgtaaaacagatatcacagcctgattttaataatattttatcatctatacctgatagcggtaactattatgtaactaattcaagaaatgctcctgcaggagaagcaacagcaggatttgtaagattagataaaagaaatgtaaattattacaaaatatattattcaccttatagcagtaataaaatgtatattaagacttatgctaatggaacagtatatgattggattagttttaaattagatgaaggtagtttatataatgagggtaatactattaacgtcaaagaacttactgaatctacaacacaatatgcaacactagttaatcctcctaaagagaacttaaacactggatgggttaattataaagaaagtaagaatggtgtttcttctttagtagaatttaatccagttaactctacttcaacttttaaaatgataagaaaactaccagtacaagagcaaaaacctaacttacttagagatagtttatttgtttatcctgaaacaagctcttctaacattaaaacggataattgggctacacctccattttggggatatacagctaatagtggtcgttcaggagttagatttagaggagaaaacactatacagattgatgatggtaatagcacataccctacagcaatgactaatagatttaaaatgggtaatgagctttctgtaggggatactataactgtatcagtatatgctaaaattaatgaccctgctttacttaaagataacttagtttattttgaactggcaggatatgatactgtagatagaacagataatccttatacaggtggtcgaagagaaataacagcaagtgaaataactactgagtggaaaaagtattcatttacatttacaatacctgaaaatacgattggtgcgtcaggtgttaaagttaattatgtgtcactacttttacgaatgaattgttcttctagtaaaggaaatggtgcagtagtatattatgctttacctaaattagagaaatcatctaaagtaactccgtttattacacatgtaaacgatgttcgtaaatatgatgagatttggtctaattggcaggaagttattagtaaagatgaattaaagggtcattcccctgtagacattgagtataatgattacttcaagtaccaatggtggaagtcagaagttaatgagaaaaacttaaaagatttagctatgactgtacctcaaggctatcatactttctattgtcaaggttctattgaagggacacctaaaggacgctctattagaggaactatacaagtggattatgataaaggtgacccttatagagctaataagtttgttaagttattatttacagatacagaaggtataccatatacattatattatggtggttacaaccaaggttggaagcctttaaaacagcaaagaacatctacaatactttgggaaggcactttggattacggttcaaaagatactattcctttaaatgattcatggactaactatgacttattagaagttgtatatctgactcaatcagcgggacattataaaacaatgtttttagatttaagaatacctacgactccgtatttatatataagagattttaatttatctaacaactctacaggttcaggagtagacttctttgaaggatatttaactttccctacaaatacttcagcaacaccaactatggttaaaaaggttactttaaatgggtctactaatacaacatctgtaacagattttaatgcacaaggaataataactatatatagaatagcaggaattaacacactttaggaggttagataaaatggctagacaatttgatattggtagagacgaaatagtattacaccttagagatggtaaatatattacaggatttacaacggcaggagcttatgatgaagactttggtcaggttaaggttaatagagaaattttacctgcttacttctttgataactttgctcttgatagatacctatactataaaaaaccggaagaggttatagagaataaaaactatgtacctcctcaaattaataatagtgatgaggaatctcaacaaaatactgtacctaaagaacaatatgatagtttaaaagaagagctagaacttatgagacagcaacaagaagctatgatgaaaatgcttcaacaactcttaggtcaaaaggggtaataataaatggcattaaattttactacaataacggaaaacaatgttattagagacctgactattcaggtcaataacattggagaagaattaacaaaagaaagaaatatatttgacattacggatgatttagtttataattttaataaatcacaaaaagttaaattaacagatgataagggtttatctaaatcttatgggaatataactgtaattagggatataaaagaaccaggttattattatataaatgcaagaacattagctacattattagataaacctgatatggaatcaatagatgttttacttcatgtactacctttagattcatctactagagtagtacagcatatatatacattgtctactaataacaatcaaattaagacattatataggtttgtttcgggaaactctagttcagaatggcagtttataactggattacctagtaataaaaatgctgttatttcaggaactaatatcctggatatatcttcaccaggtatttactttgttatgggaatgacaggaggaatgccaaaaggtgtaagttcgggatttttagatttgaatatagatgctaatgataatagattagctaagttaactgattctgaaacaggtaaagaatacactagtattaaaaaacctacaggtgtatacacagagtggaaaaaagaattagaacctcaagatatgcaaaaatatttattaagtagtatcagggatgatggtagtgcatctttcccattacttgtgtacactagtgataataagacttttcaacaggctgttatagaccatatagatagaacagggcaaacaacctttaccttttatgttcaaggtggtgtgacaggttctcctatgtctaatagctgtagaggattattcatgtcagatacacctaatacatctagtttacatggtgtttataatgcagtaggtactgatggtagaaatgtaacaggctcagtagtaggtagtagttggacttttcctaaaacatcaccgtcacataaagaattatggacgggagcacaatcattcttatccacaggtactactaagaatttagcagatgatattagtaattattcttatgtagaagtttatactaaacataagacatcagagaaaactaaaggtaatgatgatacaggtacaatttgtcataaattttatctagacggtagtggtacctacgtttgctcaggtacatttgtatcaggagatagaaccgatacaaaaccaccaattacagaattttatagagtaggtgtatcctttaaaggttcaacatggactcttgtagatagcgcagtgcaaaatagtaaaactcaatatgttacaagaattataggtattaatatgccatagactaggaaacttatcctagtctttttttcttgacttgagaaggattatgtgatatactataactcgtgtaaggatataaggagattaaaatgagattaagaattaagaacttatatacctatgtagaatttgaggaggatgataaatacttaaaagatatatttttaaagagagttcatacgactataggagcaaggcaggagggattccagtatagccctgcttacaaaagaggtagttgggatgggtatgtagacttttatgtttatgaagaagataaatttcccactggacttttatttaagattgagttattattaggggagttacaatcaagatataacttccagtttgaaacaattgatgagcgtgatgaaagtttcttagctgaggaagatattgatgatgaaataacattacttgataataatattggtcaaattactttaagagattaccaatatgaagcagtatataatagcttaacattttacaatggtattgctcacttagccactaacggaggtaaaacggaagttgctagtggtattatagaccaactattacctcagttagaaaaaggagaaagagtagcatttttcacaggctctacagagatattccatcaatctgcagatagattaagagaacgtttaaatattcctataggtaaagttggtgcaggtaagtttgatgttaagcaggttacagttgtaatgatacctacattgaatgcaaaccttaaagaccctacacaaggggttaaggttacacctaaacaaaatattagtaaaaaaattgcacaagagatattacctaaatttgaaggtggtacaaaccaaaagaaattattaaaagtattacttgataatacaacacctaaaacaaaagtagaacaaaatgtattaaatgttttagaattaatttaccaaaatagtaaaactgatgcagaggtcttgttaaacttaaaaaaacataatgcacatttccaaaaagttgttagagaaaagaatgaaaagaaatatgataaatatcaagatatgagagactttttagattcagtgactgttatgatagttgatgaagcacatcactctaaatcagattcgtggtataataatctaatgacatgtgaaaaagctttgtataggattgcattaacgggttctatagataaaaaagatgaattactatggatgagattgcaggctctatttggtaatgttattgcacgaactactaataagtttttaattgatgaaggtcattctgctagaccaacaataaatattatacctgtagctaatcctaatgacatagatagaattgatgattacagggaagcttatgataaaggtataacaaataatgattttagaaataaacttattgcaaaactaacagaaaagtggtataatcaagataaagggacattgattattgtaaacttcatcgaacatggagatacaatatcagaaatgttaaatgatttagatgtagagcactacttcttacatggagaaatagactctgaaactcgtagagaaaaattaaatgatatgagaagtggtaagcttaaagtaatgatagctacatcacttattgatgagggtgtagatatatccggtattaatgcgctaatattaggtgcaggaggtaaatcgttaagacaaacattacaacgtattggtcgtgcgttacgtaagaagaaagacgataatacaacacaaatatttgattttaatgatatgacaaatagatttttatatactcatgctaatgagcgtaggaaaatttatgaagaggaagattttgaaataaaagacttaggaaaataggagggtaagagatggcaacaagaacacaacgaaagttataccaatatctagaagaaaatgctacagaaaataaatttcatatttctactaagaaagagttagcagattctctaggcgtttccatctctgctttatccaataaccttaaaaagttagaagaagaaaataaagttgttactgtttctaaaagaggaaaaaatggtggagtaataataactttagttagggaatatgacacagaagaattgaaagaatttaataattctacagataatatcattacttctgatttacagtatgctaaagcattaagagaaaagcactttccttcttatagatacgagaggaaagaacagcgtagacgtactaagttagaaatggcacagtataatgctattaaagatgaaaagagaagaattatagcagatatgaactttcattcagaaggtcttccttatccttctaaagatatatttaatatgtcttatgacccggaaggattttataaagcatacattctatgtaagttatatgaccaatatgctatttctcatatggatgctaaacatacaagccatcttaaagcaatgagtaaggcaacaactaaagatgaatatgattaccatcaacatatgtctgaatactatagaaataaaatgattcaaaatttacctagaaatagtgttagtgataatttcttcggtagtaaaatgtttaatactttctataatttttatttaaaaataaaagataaaaatattaatgtatttaaatatatgcaaaacgtatttaagaatgtaacattttattatgagaatggtatgcaacctaatccaataccttctcctaacttctttagttcagataagtattttaaaaactataataattatattaaaggaataaaaaaaggtgttaatagtacaaatagacacttaggggatacagatagtattattaattcatcagattatgttaagaaccctgctgtattacatttacatcaattatatactacaggattaaattctactttacatgatattgatactatgtttgagcaagccttagaccttgagaatgcttcttatggactatttggagatatgaaacatattattttactacaatataattctatgattgaagaagaaattaagaacttacctacagaagagaaaagtattattaataaatatgtaaaacaatgcataattaatgattactccccaacaagcatatcaccatctgcaagattatcaatgtttactatgcagaaagagcatatagtttataataaacagttaaacagaggaatcaagagagaagatttattaccattaagtctaggaggtatagtgaataaagattcactaagtggtatggatatacaaaacttagagcagaatggtaatgagtacctatatatgagacaacatacttcaacttattatatactaagaatgtttggtgattatctaggatatgaagtaaacttaagagaagtaaaatatattgtagagaaatataatttaattgataaaataccattgacaaaagagggtatgttggattataataaacttatacatttagtagaggaagaggttaataactatgagtaagaagataaaggagcttatccttcataaatcaatgaaggatatacattttgcaagagaagtactagataacttacctaagaacctattttcagcagaatctgaagatatgggttacttatttacagctataaaaagaacagcacatatttccgataagatgtctaatgaagcattagcaattaaagtagaacagcttatgggaaataataaggaagatgaagaaaaagtaaccaagacattgacttacttagaagatttatataaagtagatgttaatgaaaaagatgaatctgttaattatgaaatagagaaatatattaaaacagaaatgtctaaggaagtattagttaagtttattgcagaaaataaacaagaagactcagacaatttacatgaacttgtagataaattaaaacaaatagaagtaagtgatatttcaggaggtaacggagaatttattgatttcttcgaagacactgaaaagaaacaagaattattaagtaatttagctacaaataaattctctacaggatttaactctattgataatcatattgaaggtggtatagcaagaggagaggttggattaattatagctccaactggtagaggtaaatcattaatggcttctaacttagctaaaaattatgtgaagagtggattaagtgttttatatattgcattagaggaaaaaatggatagaatggtattacgtgcagagcaacaaatggcaggagcagaaaaaagccaaattgtaaaccaagacatgtctttaaacagtaaagtttatgatgcaatacaaaaccattatcagaagaatagaaagttactaggtgacttttatatttctaaacatatgccaggagaagttacaccaaaccaactagagcaaattattgttaatacaacaatcaagaaagataagcatattgatgttgttattattgactaccctcacttgatgagaaatccatatgctaaatatcactcagaatcagatgcaggaggaaaactgtttgaagatattcgtagattatcacagcaatatgggtttgtatgttggactttagctcagaccaaccgtggagcttatggttcagatgttattacaagtgagcatgtagaaggttctcgtaagattgtcaatgctgttgaggtttctctagcagtaaaccaaaaagatgaagaattcaagagtggtttcctaagattatacttagataaaattcgtaacagttctaatacaggggaacgatttgttaatcttaaggtagaaccaactaagatgattgtaagagatgaaacaccggaagaaaaacaagaacatatacagctattatctgacaatggaaaagaagatacaagtaaattccaaaataaagataataaaatagaagctataaataacacattcggaggattaccgggagtttaaatttttactatataccacttgacattttatatgttaggtggtataattattttataaagaataaaaggagagattaatatgaaaattaaacaaatattacctagtaataatccaaacaaatatcaccttttgattgagagcaagctaatacctagttactactcaacaagagatgatgtttataatgattattatgatttaaatctatatggtatgtttgatgatagtgaaaatttattatgttcatgtgcaatagaaaagtataatgaattagtatttatgaaaaggtttgttatggttggggaacatggtaatggatattttaaacagatggtttctcttataataaaagaagaacctcatatatgtttaactataaataaagataatattaaagtagctgatatcttaaatgaactaggatttattaatgcaggagaagtaattgatagaacaggaaagtatacttatgaattataccaaggaggaagagcttaatgaagtttgtattttttacagatagtcattttcatttatttacaaactatgcaaaacctgatgatgaatttgtaaatgatagatttaaagagcaaatagaagcattacagaaagtttttgatattgctaggaaagaaaaggctaatgttattttcggaggagatttattccacaaacgtaattcagtagatactagagtatataacaaagtatttagtacatttgctaaaaataaagatgtccctgtattattacttcgaggtaatcatgatgctacaactaattcattatataccgattcaagtatagatacatttgagtatttatctaatgtaagtgtaataaagtcattaaatacaattttaaaagataatgttaatattgtatttacagcttatggagatgaaacagaagaaataaaaacctacattaacagtaactatgataaagatatggttaatatactagtaggtcatctaggtgtagaagggtcattaactggtaaaggttcccatagattagaaggagcctttggatatcaggacttattacctgataaatatgattttattttactaggtcattatcatcgtagacaatatttccaaaacccaaaccatttttatgggggttcattaatgcaacaatcattttctgatgaacaagaagctaacggtgttcacctaatagatacagaaaagatgaccacagaatttattccaattcatacacgtagatttattactatccagggagaagatatacctgaaaactttgaacaattaatagaggaagataattttattagagttattggtacctcaaaccatgctaaagttttagagatggatgatagtatgaaggataaaaacgttgaagttcaaattaaaaaagaatatactgtagagaaacgtatagatagtgatgtatctgatgaccctctaacaattgctagcacttatgctaagcaatactcacctgaatcagaacaagaaatacttgaatgtttgaaggaggttttatagtgagaaaatataaagaatatctaaacaagtcagatgaagaaaatttagcagaagattgggaacggataaaagaagatttatggaaagtgtttaaagatatgaaacctaaaattaatacattagacatcagtaatgtagtaagtaaagacttagataaaagtaagcctattttacaatttcaagattcagacagagtaatagagaacatttgtaatgttgaaggtttagaagatggtttatctaaaatgaaaaagatttttgacgatagtaattttgaaaaacattactataatagaactgtagaacatgatgaatattattggattgattatggttctcatcattgtttctttagggttacgaaaggagataagtaatggtcgtatttaaacaagtagaagttaataattttttagcaattaaagaggctacactagagttagataatagaggtttaatacttattgaaggtgaaaataaatccaatgagtcattccattcaaatggttccggtaagtcaactttaatatctgccattacttatgctttatatggtaaaactgaaaaaggattaaaagcagatgatgtagtaaataatattgagaagaaaaatacatctgttaaacttaagtttgatattggagaagatagctatttaattgaacgttatcgtaaagataaagagaataagaacaaagtaaaattatttgttaatgataaagaaattacaggctcaacaaatgatgttactgataaacagatacaggatttatttggtattgagtttaatacgtatgttaatgctatcatgtatggtcaaggagatattcctatgttctctcaagcaacagataaagggaaaaaagaaattcttgaatctattaccaagacagacgtatataaacaagcacaagatgtagcaaaagagaaagttaaagaagtagaagaacaacagaataatctaagacacgaaatagataaactagggtatcagttatctacaaaagatgaatactttcaaaaggaaattgaacagtataatcaatataaagaacaattggctcaaatagaaaatagtaataaggaaaaagataaattaagggagcaagaggagaagcaaatagaagctcaaatagagcaattaacttcacagataccaacaatacctgaagatgaatttaagcactcagaggagtataataaagcttctcaaagcctagatttactttctaataaattaactgaactaaatcaagtatatgcagagtataatactaaagagcaggtactaaaatctgaaatagctacattaagtaatagcttaaatcaattagatacaaatgaccattgtccggtttgtggttctcctatagataattctcataaattaaaagagcaggaaaatattaataatcagattgagaataagaaacaagagattactagtgtactagaaattaaagatacgtataaagaagctattgataaagtaaataataaatcacaagaaattaaagacaaaatgtctcaagaagaccaacaagaacgagagcacaacactaggattaataatatcattcaagaggcttccaagattaaatcagatattagttcattagagaataataaaacttatttaaaagtgaaatatcaacatcaatctgttcaaggattagaaagagaagaaccaagtaaaaagaaacatgaagaagataaaaaagaattacaagaatctattgacaaacatgaagagaatgtagtacaattagaaactaagaaaggtaagtatcaacaagctgtagacgcttttagtaataaaggtatacgttcagtagtgttagactttattacacccttcttaaatgagaaagccaatgaatatcttcaaactttatcaggttcagatattgaaatagagtttcaaactcaagtgaagaatgctaaaggagaactaaaagataagtttgatgttattgttaaaaatagtaaaggtggaggctcatataaatcaaactcagcaggagaacaaaaacgtattgacttagcaattagttttgcaatccaggatttaattatgagtaaggatgagatatctacaaatattgcactttatgatgaatgttttgatgggttagacactatagggtgtgaaaatgtaattaagttattaaaggatagacttaatacagtaggaactatatttgtaattacccataatacagaacttaaaccactgtttgagcaaacaattaaaatagtaaaagaaaatggagtatcaaaactggaggaaaaataatgaaattaaagattttagatagagataatgcaacacttaatgtgtttcatcgtaataaggagcacaaaacgatagataatgtacctactgctaacttagttgattggtatcctttaagtaatgcttatgaatataagttaagtagaaatggagagtatttagaattaaaaaggctacgttctaccttaccttcttcttatggcttagaggataataaccaagatattattagagataataaccatagatgtaaaataggatattggtataatcctgcagtacgtaaagataatttaaagattattgagaaagctaaacaatatggtttaccggttataacagaagaatatgatgctaatattgtagaacaagggtttagagacattggagttatattccaaagtcttaaaactattgttgttactagatacctagaaggtaaaacagaagaagaattgagaatttttaacatgaaatcggaagagtcacaattaaatgaagcacttaaagagagtgatttttcggtagatttaacttatagtgacctagggcagatttataatatgttactattgatgaaaaaaattagtaaatagtaaggaaggatattatgaggtttgaagactttttaacccaagaattaggagaaccaaaagaaaatactataggtgaactaagatactgttgtccgttttgcggagaaaaaagttataagttctatgttaagcaagctttagactctagtaatggtcagtatcactgtaaaaaatgtgatgaatcaggtaatcctattacatttatgaagacttattataacattacaggtaaacaagcttttgatttattagagtctaagaatatagatatagagagagcccctttacttacaactaataataaggatttaacagaatcagagaaacttatattaatgcttagaggcgtacaccaagataaaggaaacactaatcttaaacctcctagattacctgagggatataagttattaaaagataacttaaataataaagagattataccttttttaaaatacttaaaaggcagaggtataactttagaacaaataattaataataatataggttatgttattaatgggtgcttctataaagttgatggagaatcaaaagtctcattaaggaatagcattatattttttacgtatgataatgatggaaactaccagtactggaatacacgaagtatagagaagaacccttatattaaatctatcaatgcccctgctaaacaagatgaagtaggaagaaaagatgtcatatttaatttaaatatagcaagaaagaaaaaattcttagttataaccgagggtgtctttgatgctttaacctttcatgaatatggagtagcaacactaggtaaacaagtaacagaaaatcaaataaaaaaaataattgattatgttagcatagatacatcaatatatattatgttagatactgatgcgttagataataatatagatttagcttataagctaaaaacgcactttaacaaagtttattttgtaccgcatggtgatgaagatgcaaatgatatgggaacaaggaaagcttttgagctattaaaacagaaccgagtactagtaacacctgaaagtatacagagttacaaaatacaacaaaaacttaaactttaggcttgaccttagagaagttttatgttatactaataattaagtaattaataaaggagaaaaaataatgtcaaataataaaaaagatattttagaatttgtagatgaatacattacagctttaagagttggtaatgagcaacgacaacatcaattagaagaaatgggtaaagaagaaacagcaacattaacagatgtagctaaagctattactaaccttatgttaggtgttaatgagcaaatgacagacttggaatacaacaatgagttaaatttaaatattttaattgacgctttatataaagcagaacttattaatgaagatgtactagattacatccaagaatcaattgataaatcacaagaagaacctaaaaatgaagaagaaaaaggagaacaagaataatggaaaaaaatattagcacacacacaaaaggtattagtcaagcagacatggagaaatggattgaagctgtagtccaaggaactgttgatggtaaacaagttgatgaaaaaacagctaaacaactagatagaattggttcacgcagtgtttctttagaagaagcaactcgtattgctaaagtcattaatgctgttacagttcaagagatgtcaggagattttaatgacgcatttaacgcaattgacttaatgatgattgttatggaagatgagttaggagtaactcaagaacaagttggaaaagctaaagataagttaaatgagaaacgagaagcttatttaaaagagaagcaagaagaattacgtcaaaaacaacaagaagagacacaaaaagaaactgaatctgacagcaatgaaaaagtaattcagttgaagaaaaatgacgaacagtaagaaaaaaggagatacattcgaacgtaaaatagctaaagaattaactgcttggtggggataccaatttaataggtctcctcaatcaggtggtgcctcttggggtaaagataataatgctgtcggagacatagtagtacctcaggaagctaattttcctttagtagtagaatgtaaacatagagaagaatggactatagataacgttcttttaaacaatagagaaccacatacatggtgggaacaagtaattaatgatagtagcaaggtgaataagacaccttgcttaatatttactagaaacagagctcagagttacgttgctttaccttatgatgagaaagtatatgaggacttaagaaataatgaatatcctgttatgagaacagattttattattgataatattagaaaagataaatttttttatgatgtccttataactaccatgaatgggttgacctcatttacaccttcttatattatatcttgctacgacaaaaaagatataaaaccatacaagaaggttgagtctaatttatctgaggtaagtaagcatgaagatgaattgattaatgaccttcttaatgatatataaggaagggtaagataggtatgacaagtaaagaaagaccattaattgtatatttttcaggtacagggcagacagaaagactagtaaacaaaattaatattaataactcatttgaaacgtttagggttaagagtggaaaagagaaaataaataaaccttttatactaataacaccgacttatatgaagggtgcaatacctaaacaaatagaaagattcctagaaattaatgggagccctaaggaagtcattggtacaggaaataaacaatggggctctaatttctgtggagcaagtaaaaagatttcagagatgtttaagattcctttaattgctaaagtagagcaatcaggacactttaacgagatacaaccaatattagaacactttagtaataaatataaagtagcgtaaaggatgagagatatatggcaacatatggaaaatggattgagttaaataatgaaataactcaattagatgacaatggaaaaaataaactctataaagaccaagaagctttagatgagtatttaaaatatattgaagataatacaagaaagtttaataatgaagtagaaagaattagagtattgacaaaagaaggaacatatgataaaatatttgataaagttcctgatactattattgatgaaatgactaagctagcttacagttttaattttaaatttcctagttttatggcagggcaaaagttttatgagtcttacgcatcaaaacagtatgacgagaataaaaaacctatttttgttgaagactatgagcaacataacgttcgagtagctttatatttatttcaaaatgattatgtaaaggctagagagttattagtacaacttatggagcaaacatttcaaccatctacacctacgtataataactcagggcaagctaatagaggtgaactaagttcatgttatctatttgtagtagatgattcaattgagtccttaaattttgttgaggatagtgtagctaatgctagttctaatggtggcggagttgcaattgatttaactagaattagaccgaaaggtgctccagtacgtaatagacctaattcaagtaaaggtgttattgcttttgctaaagctattgaacataaagtaagtatatatgaccaaggcggggttcgacaaggtagtggtgcagtctaccttaatatattccataatgatattttggatttattaagttctaagaaaataaatgctagtgaatctgttagacttgataaactatctataggtgttacaatacctaataagtttatggaattagttaaagaaggtaaacctttctacacgtttgacacttacgatattaacaaagtatatggtaaatatttagatgaattaaacattgatgagtggtacgaagaattattaaataatgataaaattggtaaagtaaaacatgatgctagagaagtcatgacagatattgctaaaacacaattagaatcaggttacccttatgtattttatattgataatgctaatgacaatcaccctcttaaaaatctaggtaaagttaaaatgagtaacttatgtacagaaatttcacaattacaagaggtatcagaaatttatccatattcctatagtaatcagaatgttattaatagagatgttgtttgtacattaggttcacttaacttagttaatgtggttgaaaaaggtttattaaatgagtccgtagatattggtacaagagcactaacaaaagttactgatattatggatttaccatatctacctagtgttcaaaaagcaaatgatgacattagagctatcggtttaggttcaatgaatttacatggacttttagctaagaatatgattagttatggttctagggaagctctagacctagtaaacagtttatatagtgctattaacttccagtctattaagacatctatgttaatggctaaagaaacaggaaaaccatttaaagggtttgaaaagtctgattatgctacaggtgaatactttgtaagatatattagagagtctaaccaacctaaaacagataaagctaagaaagtcctaagcaaggtctatattccaacacaagatgattgggatgaattagctaaagcagttaaagtatatggactgtataatgggtatagaaaagcagaagcacctactcaatctatatcatatgtacagaatgctacaagctcaattatgcctgtacctagtgctatagagaacagacaatatggagacatggaaacatactatccaatgccttatttaagtcctataactcagtttttctatgaaggagaaacagcttataagattgataataaacgtattattaatacaagtgcagtagtgcaaaaacatacagaccaagcagtatctactatactttatgtagaatcagaaataccgactaataagttagtatcattatattactatgcttgggaacaaggattaaaatcattatattatacacgttcacgtaaactttctgttattgaatgtgaaacatgttcggtttagaaaggaaatagatatggatattacacaaaaagtaaaacaacataataaaaatgcagtattaaaggcaacaaattggaatattgaagatgacgggatgtctgatatttattgggagcaaggaatctcccaattttggactcctgaagagtttgatgtatcaagagatttaagttcttggaacagtttaactgagagtgaaaagaacacttataagaaagtccttgcagggctcacagggctcgatacgaagcaaggaggggaaggtatgaacttagtatcttatcatgaaccaagacccaaataccaagctgtatttgcgtttatgggtggtatggaagagatacatgctaaatcttatagtcatatctttacaacactattaagtaataaagaaacaagttatttactagatacttgggttgaagaaaatgactttttaaaagtaaaagctcagtttattggatattattatgaccaattattaaaacctaatcctactgtatttgatagatatatggctaaagtagctagtgcctttttagaaagtgcattattttactcaggattttattaccctttacttcttgcaggaagagggcagatgacacaatcaggagctattatttataaaattacccaagatgaagcttatcacggttcagcagtaggattaacagctcaatatgattacaatcttttaacagaagaagaaaaaaaattagcagatagagaaacttatgaattattaaatattctttatactaatgaagtagcgtatacacatagtctatatgacccgctagagttaagtgaagatgtaattaactacgttcagtataactttaatagagctcttcaaaaccttggaagagaagactattttaaccctgaaccttataaccctattgtagaaaatcaaactaatgtagacagattaagaaatgttgatttctttagcggtaaagcagactacgaaaaatctacaaacattaaagatattaaagatgaagatttctcattcttagatagtaaagagtatagtactgctaaggaattcctataaaaaggagaaaagatattatggatagaaaagaagcaatggatttattaagtaaaacagaaatattatttaaaaaacatgatgagttttcatgtgtgagtgatatcaatgaccctatgaagttatttagtaactctaaagatgccaaagctgatgatacgtctaagtcttttcagttagagtttatgcatgatatgactatgtatactttatcttatggctcaggacagttaaaactcattgatttatcagaaggttatgaagcacaaaaagctacagcagttaactcatttcccgaaattattaaaacattagaaaaggatgactcagaagatggaaaaaatgaataatttagtagatttaaatacagcaattagacaaaagaaagatgttattgtcatgattacacaagataattgtggtaagtgtgaaatcttaaaaagtgtaatccctatgttccaggattcaggggatattaagaaacctattttaacacttaatttagatgcagaagatgtagatagagaaaaggctgttaagttatttgatatcatgagtacaccagtattaattgggtataaagatggtcagttagttaaaaaatatgaagaccaagttacaccaatgcaattacaagaattagagtcactttaatttggaatttcctactatctgtgctatactataatagtacaaggtagtaggatttttttaatgaaaggaagatgacatatcgcaaagaataaaacattaacgatatataatagtgatagatattttaatatacacacaaaagataaagataaaattaatgaggctattaaagtcacacacggtaatgaagaagaaattgaaaagaatatggatgaactaatatctaaatctagacgatatattatgagagatgaaaatcattatatgttatttaatgagaaatacaataatgataggctcatagagaaagtatgtaaacatggtggtaaagttacatactatactgattcagtattaccttattatgttttaaaagacttatctagtcaccctgattcagaagttgtttatcgtatgcgtaacggctttactgcaaaagaagtagataatatagctttatcatttatgggaacaaaagttattattgatatttctgtggtatttccttatgtaaatccttatgatattattagaagtttacatgatattaaaacaaatgtagatgaagttcatttatcatttcctcgtatattagaagtagatgaaaaacaagaaaaattttatttctttgatggtgaagcttatgatttaaaacctgaatataaagttgattttgcagataaaattagagtgtccctatcagtatggaaaatgtatatctatatcttaacaagtagtcgtgattttgaagatgtagacaatgtaattacgaaactaaaacaacaacgaaagattaagatataaggtgattatatgagtacagcaaatagaagagatatagcaaggaagatatcagagaacacaggttattatatacaagatgtagaagagatactaagtgcagagacagatgctatttctgacttactagaagaagggtatactaaagtaaagaatcataaatttatgcaaatagaagttattgaaagaaaaggtaaaaaagcttgggatgggctgaataaagaatatttccatttacctaatagaaaagctataaaatttaaaccacttaaagaattagaagaggttattgatagacttaatgaagaagagaaataattctcttctttttttattgacaagatttaaaatatatggtatagtattattaagttaaaaaaggagaggaattaaatgaaagtattaatcttatttgaccacattagagaagaacatttttctgtaagtaaagatgggagtgtgaaatctaatgtattaaatacacctaatggaaaaacacttaagaaattacttgagaagtgttctaacttaaagagagataaaacaaacagagactatgatattgattttctctataacgcagtacctacacctattagaaatgattatggtaaaattattaaataccaagatgttaaacaagcagaagtaaaaccatattatgaaagaatgaataacattattattgataactcctatgatatgataattcctgttggtaaactaggtgttaaatacttattaaatgttacagctataggtaaagtaagaggagtaccaagtaaagtaacaattgaaaatgaaatatcttctcatgatgtatgggtactacctacgtatagtattgaatatacgaatgtaaataaaaatagtgaacgtcatgttgtatcagatttacaaacagtaggaaaatttgtagaacaaggtgaagaagcatttaaacctaaagaagtatcttacgaattagtagataacattgaaagagtaagggaaatatttaataaggaagtaaagaatgataattatgatggtgtagatatcaccgcatgggacttagagactaactcattaaagcctgataaggaaggaagtaaacctttagtattatcactatcatggagaaatggtcaaggtgtgactatacctttatacaaatcggactttaattgggaaaatggtcaagaagatattgatgaagtactagaattacttaagaattggttagctagtaaagaagatattaaggtggcacataatggtaaatatgatattaaatttttaatgagtactgagaactttaaagattttgagaacattcaagatactaaagtaggttggtatttagctgtcacacaagaagttaaagaatctttgagattatctgacttagcttacgaggtaacagatgtcggaggttatgataaaccactagaagattttaaattatggtttgttactaagttattaagatttttctctgataaaattaaagaaatacagaaagaaaataaaaaaattgctaagaaagagtatgatgttaaagctcctgaatacaaagagtggttagagactaaattaaatgaaacaatagtagaattagatgatactgagaagaaatttagagttagtgaattagagaaaaaatacattcagttaggtctttcacctgaaattgtaaacatgaatttagttatgaacaacgatgaatttattagtattgcagagcaatcacctgaatatatgggattatctgattacgctaaatcttacacactgaatactgcaattgatttaattaacaagtatagagatgtaaaagatgtaattaatgatattgatggaggtaactttaactatgattggttccctattgagttaatgcacccgtacgcatcaggagacactgatgtatgtagaagaattcattgtgatgttgttaagaaacttaaagagcaagatagacctaagtcaatgcatttattagaagttaattacccaagacttactaaatcattagctagaattgaatcaaatggtttatactgtgatttagattacatgaaagaaaatgatgagtcatacgaatctgagatggctaagaaccacgctactatgagagaacattgggctgttaaagaatttgaagagtatcaatataacctttaccaaatggcgttagaagagcatgagaaaaagccaaaagatagagacaaagagattcatcagtatagagataagtttaaagatggtaaatggatgttttctcctagctcaggagaccataaaggtagagtaatttatgatattttaggaattcagttaccttatgataaagagtatgttaaagaaaaaccatttaacgctaatgttaaagaagcagaccttacttggcaggattataaaacagataagaaagctattggttatgcattagataacttagaattaaaagatgatgttaaagaacttcttgagttgcttaaataccatgctagtatgcaaacaaaacgtaactcatttactaagaaattacctaatatgattaataaacaaaaacgaacattgcacggttctttctctgagacaggtacagagacatcaagactaagtagtagtaatcctaacttacagaatttaccttctcacacatcagacgtaaacaaatttgactataagcaccctattaaacgttcatttgtttctagatttgaaaatggtgtactactaggagccgactatagtgccctggagatgcgtattattggattatttactaaagaccctgatatgctacaatcattcctaaatggtgaagatattcataaggctactgcaagtattgtttataacaaatcagtagaagaagtaactaaagaagaaagacaagcaactaaagcagttaacttcggattagccttcggagaatcaccattctcatttgcaggtaaaaacaatatgtcagtagaagaagcagaagatatatttgaaaagtacttccaaactaaacctagtgtaaaaacttctattgacaatgtacatgagtttgtgcaacaatatggttatgttgatacgatgcatggtcatagacgtttcatccgttcagctcaatcaggagaaaagaaaataagaaatgaagggttaagacaatcatttaatactatcattcaaggttcaggtagtttcttaacaaatatgtctttaacttacttagatgactttattcaatctcgtaacttgaaatcaaaagttattgccacagtacacgatagtatcttaattgattgccctcctgaagaggctaagattatggctaaagtgacaattcatattatggagaatttaccgtttgatttcttaaaagcagaaattgacgggaaagaagtacaatacccaatagaagctgatatggaaattggtttaaattataatgatatggttgaatacgatgaagaagaaattgatacatttaattcttaccaaggttatattaagtacatgatgaatttacagactttagaagattataaagagtcaggtaaattaactgatgaacaatttgaaaaagctactaatgttgttaaaagtgaaaaacatatctatcaagaaatttaataaaagtattgacaatatgtttcacttatgttatactatataggtaataagtataaggaggaaaaaagagtgaatacaggagagattagatttaatcgttctatggatgaatggattataacaagtatgtaccaggatgaattaggtgaaatgaatattgttgttacattctataatagagaagaaaataaacatggctctaccgttttaccaacagagtcatctactggagaagtaacagaagaattagcaagtcttgaagaagaatatcctttagctttaccgttaagtagtatttcagttaatatttaaaaggaggaactgataaatggagatacacattgattccctagattttacaaattttactattaaagatagaaatgggaactcacaagagtttgatattacagatgaattaaagattacagaatatacaatacaagaagattttatgcaacaatcagctaagtacgctttttgggcttctatattagagaaggtcagagcatattctgaaatggagcaaagaaatttagaaacaattggtagtaagcttaatctcacaattagacaagagtatgaacaacaaggtaaaaagcctactaaagatatgattgagtctagtgtgtatattcatgattcctatcaacaacaacttaaagttgttgaggcttggaattataaagttaaacaacttcaatatgttgtaaaagcttttgaaacaagaagagatatgatgattcaattaggtgcagagttacgacaaacaaataaaaatggtggaattactaacccattttcacattaaaaaagaaagtaaagaatataattgacaaatataaaaaactatgttataataaataagtaaattaattaaaaggagaaaagataattatggatttcaatcaatttattaacaatgaggcaagcaaattagaaagtaataacagttcttttaacaacaatgtagagagctataaacctaaaaaccctgtattacgattaggtaatattaaagatgcaaatggaaataaagttactaaagaaaatgcttttgtacgagtattacctcctgcacaaggaacaaatgttttctttaaagaatttagaacaacaggtattaactactctaagaaagatggttctcaaggattcacaggactaacattacctgcagaaccaggttcatctgtccttgacccttacattcaggactggataacaaatggcgttcaatttagtagattccctaataaacctggagtacgttattacattcatgttattgaatactttaataataacggacaaattcaacctaaaacagatgagcaaggaaatgtaatgattcaacctatggagttatcaaacacaggatataaagaattggtagcaaaccttaaggatactatgttaaaaccgtcacctaatgcacctcatagttttatttcagcaaatgaagcattcttagttaatattgctaaagctaaaaaaggtgaaatgtcatggaaagtaagtgtttatcctaatgctcctttaggtgcattacctcaaggatgggaacaacaattatcagacttagaacaattagcaaaaccaacagaagaacaaaaccctaactttgttaacttcttaatcaataacgttaataacacagagttaagtcatgataactttaaatttaaccgtgagtctaatgtattaggtgaagaaccttcagaacctaaacaagctcctactcaacaagatattgatagtcagatgccaagtaatattggaggtcaacctaaccaaccacaacaaggtcaagtaggtcagtatactcaacaaggtcaaaataatggtcaaggacagcagttacaaggtaaccaacagccaattagtaatactcaatttggtcaaggaacaccttcaggacaacaacctaataatacaggttcagttgattgggataacttagctcaacaacaatcacaaccggattcaaatccttttaatgactttgatgtaaacagtgttgatgattcacaagtaccttttgagacacaacctcaaaacacacaacaagcacctgaaccacaacaaactactcaggagcctccaaaacaaaaacaaacacaaagtattgacgatgtattaggtggtctagacttagataacctataagatatagagtgccttagagcactcttttatttgagatataattactaggaggatattaaatggcaagagcaaaaaaaggtaaagaagtagatttaacagatttaaatacaattgatttaggtaaagaattaggattaacattattatcagatacaaatagagcagatattaagaatgttatacctacaatggtacctcagtatgactatattttaggtggaggtataccgttaggtagattaacagaggtttatggtttaactggtagtggtaaatcaacatttgcagttcatttgtctaggattgcaacacaattaggtgttattaccatttggattgatattgaaggaacagcagacaataatcgtatggaacaacttggagtagatgtttcaaaattattctctattcaatcaggagaaggtagacttaaaaatacagtagaattatctgtagaggctgtaggtaaagaattagagtactggattgacacatttaatgaaaagatacctggagtacctattgtgtttatttgggactcactaggagctacacgaactcagaaagagattgacggcggtattgatgagaaacaaatgggtcttaaagcatcagctactcaaaaagtaattaatgcagtaacacctaaattaaatgatacaaatacagggttaattgttattaatcaagcacgtgacgatatgaatgcaggtatgtatggtgaccctattaagtctacaggtggtagagcatttgaacatagtgctagtttacgtattaaggttcataaagcatcacaattaaaacaaaaaagtgaattaactggtaaagatgaatatcatggtcatatcatgcgtattgaaactaagaaatctaaattatcgagaccgggacaaaaagcagaagcagacttactatctgattatatggtaggtaaagaagatgaccctatattattaaatggtattgacttagaacatactgtatataaagaagcagttgaaagaggtttaattactaaaggtgcatggagaaactatgttacattgaatggtgaagagattaaacttagagatgctgaatgggttcctgtattaaaagataatagagagttatatttagaattattcagtagagtatatggagagcatttccctaacggttactcaccattgcttaataataaagtaattgtaactcaactagaagagtatcaagctcttgaaaattactataaagaatgggctacagataataaacaaaaggaacaagaggaagaactaaaaggagaatctcaagaaaaggattctgaataataaatggataatttaatagataaaaacatgaatcaggtaaaagaatctttggggaatgcaaattcctcagatgttcttcctttaccttataaagatatagcaaagaaatttgaagaagtaaaagaaaaaggtgaatcaattatcattgaagaaggtggattcccttacacagattctacagtgatgtatatagaacatgtaacagatagatgggcaggaggatactccttaattagacatgaaggtgaagaggttaaagtgcctaaaactatccatttctctgatatatatgttaaggataagtcacataaagtaagaataatcttcgagggggctaatccttatgaagaaagctaacaatggtaatagatatgtaatagatatagatggtattcctgttgattttgaaagagacttggatagtttacttaacaggtataaaaaccttagatggtcgttgtatcatagatatgcaggtatattatctaatgactttgaaagacaagaattaagagaatatattgatgagcaatttattaaactagttaaagaatataatattagaagtaaagtagattttccagggtatattaaagctaaattaactttgagagttcaaaatagttatgttaaaaagaatgaaaagtataaacgtactgaaattatcggtaaaaaagattatacggtagagtccttaacagaagatttaaatgaggactttgaggataatcaaattatgagttatgtatttgatgatatagaatttacagaagttcaaagtgagctacttaaagaattacttattaatcctgaaagagaagatgatgcctttatagtttctcaagtagcggagaagtttgatatgaaaagaaaagaagtagcaagtgaattgacagaattaagagattatgttagatttaaaataaatgcatatcatgagtactacgcaaagaaagaattaaataatcatagagttaatactgaaaatcatatttgggaaaactagttacagtgccttccttgtgttatattattatcgagaattcaataataaagcatagggaaggcttttttctatgtcttatagaatgctttaaaatagattactaaaataaagattggagattaagcttatggctaaaaagaatgttaatgatgtattacaacaagaatctgttacagtagcagataagtatttacaagttaaagttaaccgtgacggttatactcgtacacacgaaggacaatatgcgtacaaagtagtttcagagggagaagagttattcttatacccagtacaaacagatggtaaaggtacattaaatgtaatgaagaaatcacctattgcttacactgatggagacaatatccattttgtagtaaatacagtagtagacccttataatcactcatttatccgtactgaagatattaaaggattagataaaggtaaacaacttattcaagctttcttagctttcgttgaagaccgtttcaaatttggtgtttataacgtatttgttgcaaataacaaagaagatgtattatctatcgtagaccctgcagataatgatgcagatgaagttaaagatagtttagagcatgcacatgaagatgtaattgcggatttccctgctagccctgctcgtaaggacgttaaaggcgtagattcaggagaaggtcaaggagacacttcagaaccatcagcacctaagaacgttcaagttactcctaaggaagacggagcagacgtatcagcagaataatatagataaaggatggtaaatttggctaagttaaatttatacaaaggtaatgagttactaaacagcgtagagaaaacagaaggaaaatcaacaatcacgattgagaatttagatgctaacacagattaccctaaaggtacttttaaagtatcattctcaaatgattcaggagaatcagagaaggtcgatgtccctcagtttaagacaaaagcaattaaagttatttcagttacccttgacgttgatagtttagaccttacagttggagatactcaccaactatcaacaactatcacgcctagtgaagcatctaacaaaaatgtgtcatttgaatcagacaaatcaggtgttgctagtgtaacatcagaaggattaattgaagcagttagtgcaggaacagctaatattactgtaactactgaggatggtagtcatactgatattgttgcggtaacagttaaggaacctattcctgaagcacctacagatgtaacagttgaacctggtgaaaatagcgcagatattactgcataggaggacaataaagaatggaaaagacattaaaagtttatagtaatggtgaagttgtaggctctcaagtagctaataacgatggagctactacagtatctattacaggcttagaagccggaaaaacttatgctaagggagcttttaaagtagcatttgctaatgattcaggtgaatcagaaaaagtagatgttcctgaatttacaactaaaactcctgctgaagaaccttcagaagaagcataataattaagaccaactaaaaagttggtctttttttattgacaatttataatatctatgatacactatataagaattaagaaaaggagggaaagtaatggatattccaacaatattatttagaaatccatatgattacacaaaagtaaaaaaattaatggaaaacaaagaacagtacattgtagtaaaatttgattcagtttctgttcataatttaaatgttcaaggtatgatgaatgttattcaagattacctgcacatctatggttacagagtcaaagaatacggacaagaaaatgcttctaaagatgatgaaagagacgttaaaggttacttatacgaaagagtaggtgagtaaggtatgggtgttataataaattctaaccatattcagtcagatactttatatgagtacgatagtttttttgatattgagaaagtagatacgtttgaagaaggattactatcaatacaggatgaaccaactgttttagcaggatttatctatgatgatattacatttaataaggttattaactctaattcaaatattgataacaatattaagaataatgatatttattatgtttctgatatagggttacttccggatacttttatcactgttgattctaataaaaaatactattcattattacagcagatagttgagttaagtaaagaccctttccctaaatgggtagaaacggatgcaaaagatttaactaggtattataactttcaagattttgaagatgtattcgatttaaatagtttttataaaaaagaagttgacatggtaagagaaaagtgctataataatggtaatgtatatttattatatgaagtcttgcctgattataaattacctctagcttatagtttactttcaaataaagagcatggtattgttattatcggttcacagacacgttctaataatgatatactgactttttacgttaaaggtatggatgctaaggcaatagctagcatgtttaatgtagaacatgattatgattctaatatttttcatacattcgtaaatagtcacattaatattttaggaaatcaaataactaagtttataagagagaaaggaagcagttatgagtaactataaaacaatagaagaagtacaagcagttattatcggagtattatttaaagatgaaggtaaaattgtaacatctaagtttaataaaattactaaagagtttggtttagatagaattggtaaagacgaccttaaagaaattgttgaagatattagacaagatgcctatctaaatgagcttaagaataaagcaattaaaggtaaggtaactttaggagaccttaaagatgttgcagataatcaagtattcgaaggtaataactatcatgaagaagtctctacttatgtagtagctaaagaaaaagaactatctcacttgagagaacaacgtaagcacaacagacataccgcataccctcaaattatgtttgatgaacttaaagaacatatggttaaagaattacaaggggaaacattagtagagcatcatggaagtaaagttaacattaatgatacagagttaattgtattactatcagatttccatattggaagtattgtatccgatatgactaatggtaaatatgattttgaagtattgaagtcaagactaaatcactttattgatacgacagttaaagagattgaggatagagagatttctaatgtaactgtttactttgttggagacttagtagaacatattaatatgagagacgttaaccaggcatttgaaacagagtttactttagcagaacaaatctctaaaggtactcgattacttattgatatcttaaatgtactatctaatgtagttacaggagaattaagatttggtattattggtggtaatcatgaccgtatgcaaggtaacaaaaatcagaagatttataatgataatattgcttatgtagtactagactctttattgctattccaagagcagggattattaaacggtatagatattattgataatcgtgaagatatttatactattagggataatttcggaggtaaatctattatcgttaaccacggtgatggattaaaaggtaaaggcaatcatattaataaatttatcttagatagccatattgatttactaattacaggtcacgtacaccatttctcagtaaaacaagaagattttaatagaatgcatattgtagcttcatctccgatgggatataataattatgctaaagagctacatttatcaaaaactaaaccttcacagcaattattatttgtaaataaagaaaataaagatattgatattaaaacagtatttttagattaaggatggttaataaatggatacaatttttattataggtgtagcgtttataacttttgcaacatttaatatagtctttagattatttgatttatggactacagagaagaaaatggtaagtcaaggacaacctccactaagtaattttgagtactatcatgtgatagtaccctacttagttggtgttattgttattatactgagtattatttttagagattccttgtattctgcgcaatcaggattcggtgttattattacaagctttatttatatgctagtttatgttataatcggtcttgtagggtcgtttgtacttacaatattccaagctagaaaggctagacagtatcaaacacaggaggataataatgaagttcaatgatatttatgagcaattaattaaaaatgatacaatacaaaacattcatgaatctcaagatgatgaaggaaatatttatacaatacaatttgataaaggtaatgataagtatttatttaatgttatcaatgatggattcttgaaagaaatgacaaatggtatggtagaccatcctaaaggtcaaccatattcagtaagtctaatcaataaagaaactcctagtatgtcagtgaaacaatatttaacagacgtagaagatattgtacctactattagaaaaatggaaaaggatttcttatagagtcaagtctttacttgactctttttactatatatggtatattaatatagaggtgacttaaaaatggattttaattttagtgcttttgataatagctcattagcaatgagaattagtgagggtgtatactatttcaatgataccccttattactttattgaacatatagaagaagaaatgtctgagtatgttattgtgtatgacatacatgatagagaggaaaaagaaaatcctcagaagaaatatagagtagaaccttaccaacggacaatacctggaggtacacctcttagtaatttgattaagagtatgatgcctcaacgtaaatatcctaagaaggttgtagaagaccctatatttgtagctaatgttattcctttaggaacagatacagttacaggtaaaactggaaaaggtttttttgaaagagataaggatagaactatttactcacagaaagaaccaactaaggtagtccatggtcaatacacaggtgttttcataggtctaacaagtgttaaatggaatagaacatatactcctttagaaagtgttgttgagtattgcaagagagtaaaaggagataggttaaatgtctaatgatgtagttaagttttatgaaaaagatattaaagaccttataagaactaaaaaacacatgtttaaagacgatgagataactagtgatataaatgatatacgtatatttaatgagaaagtaatttgtcaaggtaagtgtagaacagattgcttagtactagaccgtaatggtactgtcatgggtatagaaataaaaacggaaagagattctacacagagattaaataaccaattaaaatattatagtctagtatgtaagtatgtatatgtaatgtgccatgataaacatgtacctaaagtagagcagatacttaaaagatataaacataatcatgtaggtataatgagttacattaattttaaaggtaaacctgttgtaggtaaatataaagatgctacaccatcaccacatagaagcccttatcatacaatgaatatactatggaagacaaatttaatgacaatacttaggttgattagagaccctcatacttatagaacagggtatagttataatgctagcggtaggtatagtggtggggaaggcaacttctctcaaacaactcaaagtaaaagaatgaaaaaacctgctattattaaccaaataattcattatgtaggggtagataatacttataaactctttacaagaggtgttatttatggttataataatagatgggaagttatagaagaagatttctttaatactatgaaaaatggggtaagagtaatcaatgagcaaagacaaaccaaatagacgtaaagagatacagcatcaacctgttaactttgccccaacaaatactttaacaggagctaataatagtttctttgctaaaaagccctcagaacctaaggatacaacatctgttattgaatatagaatactttttattaaaagatttgataatgtaacaagtacagatgttaagttacaaaaaaaatatgcattaaatcttattagtgaggcacttgatgttaaagaaacttatctatctcttaaacaaaaaggaaagaaaacagaatctattttacacacagatagagtttattatgtgcatagaggtaaaaaacttattggaaaatgtagtattagggagcaaagaacatttaaaggtaaacatttgatatttatatttaagacaagacatagagttaaagcagaaaggaaagataaataatgttaaaaggattttcagaacatgtagataaacctacaactattaaaaccttatataagaccttaacaagtggtaaagtagaattactaggtgtatcttatggtagtgattacttcccttcaggtgttacagtacaagcttatattgaagatataggtaatgaagatgaaggtctgcagtttgttaataaagtaaacgtagtggaatcaatgaaacaggctgtagtaggtatgaacaatcaattaggttcctcaggtcttggatatgttagaactgaacaacttaaaaaagagctagaagaaactggattaatgacagatttacttgctagaggtactaacttaacttctactaagaaagtggatattgtaagtacttttattgagcctgaagtaacatatcaagacattactatagctaaagatattaagttacgtctatacaaactagaagaagagtcaccattaaacggttatacacatattgtatatcttcttactacagagaaattatatgatggtcaaacactatttggtatgctatctaagaaagataagttatctaaaggagatactgataaattattagcattctttagaaataatagtttaataagtaaaagtgtattttgtgttaagttattaagtaaagactactacttcaatttatataatacacatgaaacaggtatattctttttagaagatacggatattattactattgcttgtggtcagtcatacgttaaagttaatactaaagatattaaatctagtcatgttaaaattgaagatgagactcataaattaactgagctagtaattaacttaaaaggtgacgacacattaactattttattctaatagaatgttataaatatgtgataattaagtataaatatacgttatatagaaagttttcataatgtttttaatacagaaactagttaagttttttacacttgtcctagtttctgtgaaattatatttatgaaaagttaaaatatcttttaggtaaaggctttgtaaatagttaaaaaatatattaaaattttatacaaagtagttaataaaattatattacatttatatattatgaaataataacagaaattgtgatatattatatagtgtaaccttgaaacagttgatgttgtagggtttgtttatgttcgttaaactggtttcagaacatcagttaccataaataaatgacagttaaggagagctatataatggctagaaaaaagaatttacgaaataaaaacagtgatataaaagttgttcctgataaagaaaaagaaagtatattatctaagctataccataataaattactacgctcaaaggtagataatgctttagatgaagatatgagttatgatgatattatagaactatgtaaagaatatgatttagaattgtctaaatcagctattacaagatacaaaagtaaaagaaaagaagctattgaaaatggttgggatttaggagaattaattgataaacgtaaaaaaacaagcgtaaaagatattaaggaaaaagaaactcctatattagaagaggagcaactttctccatttgaacaatcaaaacatcacacacaaacaatctatgatgatattcaagtactagatatgattatttctaaaggtgcaaaaggattagaatttgtggaaactttagaccctgctttaatgatacgtgcaatggaaactaaagataagattaccggaaaccaattaaaaggtatgtcatttattggacttagagaattacaattaaaacaaacagctcaagatacggctatgagtgaagtattattagagtttatacctgaagaaaaacatgaagaggtattacaacgattagaagaactacaaaatgaattctacaaaaatctagatttagatgaagaaagtagaaaattaaaagaagctcttgatagagtaggctatacaatttagatagtgaggttagagtaatggcagatgagattagtttaaatccaatacaagatgctaagccaattgatgatatagtagatatcatgacatacttaaaaaacggaaaagtactgagagttaaacaagacaaccaaggggatatccttgttagaatgagtccagggaaacataaatttactgaagtatctagagacttggataaagaatcattctactataaaagacattgggttctctataatgtatctgttaactctcttataacatttgatgtttacctagatgaagaatactcagaaacaactaaggttaagtatcctaaagatactattgtagaatatacaagagaagaccaagaaaaagatgttgctatgattaaagaaatacttacagataataatggtaattatttctatgcacttacaggagaaacaatgctctttgatgaaaataaattaaataaagttaaagattagggttgacagttctgaaagtatatgatatagtatatgtatactaaaaataaaggagctaacaattatgtttatttcattaaatcaagaagagaaagaattattaactaaagaggaaaacaagtatacaccattagaaacatcaagagagtttaacacacctaaagaagaattcattgtaacaagttataatgaaggtaaacctttagattacattgcaaaagaagctaaagtaagtatgggattaatttacacagtcttaaactactataaagtaggtaagcgtaacaagaaatcacctgtagaagaaagaattgcacatatcttgaaagacaaaaacttagttaaagagattattaaggattaccagtatatgaatttacaggacatttatagtaaatataatcttcataagaatggtttatattacatcttggatttataccatgtggaaagaaaatctgaacttaaggacaaagcattggaagaggataatattgtcgttgagtaagtaaagaggttataatatgagaaataaaaaatcatttcaagagcaattaaatgacatgcgtaataaagagaaatgggtatctgaagaggagttcactgaagaagtgactccttctgaagaacctgaagtagaagaagaaaagttatatactttaaatgagttaaaagaaaatttattggatgctcagggattaaaagatgttgtcgataattttcctgcatctaagccagtatatgaatctaataagctttatatttgtacaataccaaaaggatatcgttctacagaagtacaaccaggtcaatatattggtatcagtacagggttattatcagaatcagaagattttagtcatttaagaggtcaaatgcctagaaatctttatgaaacttctcatgttttaaaacctttagtacgtattaataatacaaatctcgaatatcaacagcatgagttacttgaagatattaaagatgacaagaagatatatgatgttgaattagaagacctgaggttagtaacaggagaagaaatatcccatttagaaattgtcgatagtaagttttttgaaagtcgtattaatgaaattctcgaccgctatactgaattaacggattccgatgatttgcttatatactatagtaaattacgagaattagtaggcagtgacaaaatgatttattgctcacttctagataaatgtgttaaaattatagattaatagttagtctcctcttatattataactgtaagaggagacattttttatagaggtgttaattatgtcaagaaaagcaagtatattctatatactagtagttattgttttggctttttctatttcatcttattatatatcttctttcatgtatcacgacaaagcaaagaatgaagtctctactgagttatcaaacacgggaaagattaaagaagaaaagaacgtagaatttgtcggtgactatacacttaaaaaagtggaaaataataaagcttactttatggaaacattacctacttacctacccggtagaacaggagataacagcatagatatgaggtactacaaaacaagtagatttaaagaaggggtaaatttcaagcttattagggtatatactgaagatggggaagataatccaattcataagtataggtttgaagcagtaccaaccaaaaagtaataaggaggtgacttaaatgacaacattaattgtcgtcatctttattgctatcatttattacttatggaacagtgattgagtcaagttaattcttgactctctttttgttttatggtatattaatatatagaaaggagagattaattatggaaatggcagatttagaaagatttgatacgtttgtaagattagtttcagacgatgagctttcggaggaaagaatattagaattgagtgtagacttattaaatccgatactagaaggaggtacagcttaccaagctaaaaaacgcattagaagtaagttcggtaaaatagaagcaaaaaactttaaaagaaattataaattcttactcaagtcgatagctcaaatagaccaagggagataggacaatgacagaaagggaaaagttagttaaagagattgaagatgctaatagggacatacaattaaggttaaaagaagtagatgattataaggatagtatacgttctaaaggaacaagaaactatgtatctactaaggtattagattcagttatggtagggctaattataagtttctttattcttgtaatgttacgtgtacttgaatattttgtaacaggtaatgctgtttattcacctttagcgcctgcagttattattatgtttgttttagccttaggtacatggaaagtaagtaaaatgaataaaatagtatcctacaggggaactattaaaatgtattgggaattaagtaatgctgagcagaaccaagctaagatatttaagtatcctaatgatgaagtagatatcgtatcaaaacataacttaagacaaataacttttagtgagattaatatccttcatcttaaatatatgagatataataaggcagtagaacagcatactaagttatctaaagaactttttaaaaaagataaagaaactattgacaagaacaaataagtgtagtatagtattactaaaggaggagagatattatggttatacctagtattaaagcacaaaataaattcaagaatgaattagagtattataagcaaggtcacattagtgaaagtaaaatgttagaattagcttttgattacattcaagaattagaacaaaataatgaatatgttactaatttgctagaagaggagagatatggtgagtaaatttatcggagtgtacttatttaatttattagtagtagcgctaatttatacagtaggatttttattcttttatggtgtagctagtttagttattattataactcatgccactattgacccatttgtattagctactttcttaggaataggattcttggttattagaactgcacacagaatcatggcacgagtaatcaatgatgcagtagcccaagccattaaggataaagaaaatgaataaaggggaatttattatggataaaacattaccaaagtttagtgtatatgaagttattgtaaagactgtaattatgacaccaacagaaggaagttctgaccgagaatcattttacttttcaactcaagagttagcagaaagatttgttaaagaaaaccaagtagaaacaaaagatggaaagcgtgtatctttttctattaaagagcgtaaagtaaatcaaccaggctaacattaatttgttagctttttttattgacaaatcattttatatagtgtatagtaatattatactgaaaaggaggaattattatgaaagtttcagaagaagtaaaacagagctacttagagaataaagctaatactaaaatggataagataagttggtctgagttaaggtctagtcctgcaggtagaacattaggagacttaatatactttagtgtagttataataaataatatcatagctatagcattaacattaatgcttggagatattatcaaagatttaacggatagtaccctagtaaaaataataagtatattacttattatcatcgttgtatacggtatactatcggctttaatacctatactaatatttaaatctgtatttcctggatgggaatatactgaatggaataattcttactatttgagattacctggagaaaaagattataaatactatagctactggtatttaaatttattaggtgttactgagttttatcggacaaatgatgagggtaaagaaattaaagaaactagtttaagttgggttttttatactaaggttgatagacctgaggatattgaccattggaaaagtcaattaataactaatagacctttaacaatttctgagtacaaaaaactaaagaagctagataaagaaagtgaaattagaaaacaagaagatttagaagaatacaagcaatacaatagtaattaaagaggtgaaaaaccaatgataagttcatttgatagtgtattacttgtaatatacattattatagcttttgcagtagctatggcaatactttatttagtatttaaaggtatgacccttttattagataaactaatgatgttattactaagtaaaactaccttagatgtagaagcttgctccatgataatggcagtagtcagtacaattgtgtttggaattattgtacttttaatatggttagcagtaaataatattttattgtaaggagttttactatggattttaatgactttataaacagtgaatcagatagagtgggtaaacctaaacaaaagaagaaggtagaaaataaactaccttcttctactcctattgaagagaaggaaaaaatgttgaaaagaataagagaaaaatcattatacattgatttaaggagaaaaagaaatgactaaagaaacaaatgtactttacaaagataagtatagagattatactatagttgtaagactagtaggtaatattattgttactgaagtagataagaagcataaaacaaaattttcacctattatatttgataatggtcgagaaggtgtagagcttgtaatgcgtatcggctcagaagaacttgatatgaaagaacttagagaatttactaaagaggtatcaacagctcagaaagctttagaatattttaataaaaaactttacattaaaggcttgacagatgaagccttttaatatatactaagattataactaaaacaaagaaaagaggaatgattattatgttattaggaattttatggtttatatggggatttgtatcttattttgtagtgatgtttggaattgaattttggaaagacagatggttaccaggagttattggtgcaggagttttattaatattcttattttggattatgaagtctattcataatgctatgacagtagtttacttgtattaggaggtaatatagatgaatatattagttatccattatgaagaaacaaataaacgagttctaaaagaaacaataaaaacaatacaaaatcatttaaacgatgaacatggtttggttaaaatgacagcaacaagacttagtagaaaagccatagaagaagagtttaatgattacaatatagttattgcagaaaatgaccctgatagtttttacagctactcagatgcagtagacgatgtagattttgttatagatataccaatttcatatttagatatacatgcaggtgtagagtgggatgttgataatcctgtagatatgctagataggaaccctgattttatagaagctatgggtcaattaaacgaggacttaatgttataaggaggaaataaaatgttaaatgaaaaactaaaaaatttagaagatacgaaagtgtatatgattaatagtattgcaagtttactaagtgcaagtacaggtaaatcaagtaaagtattttttgatgaaggaactattaaaattgtaagtggtgatacaaaagcggtagaagttattgataatttagttcaccctcattcaggacgtttacctattaaaacaacagaacgtattgctcttggtagactaacagattctttacagtttgttatttcagaaatagagtcggttaaagaccaaattatagatgaagaaaatgaagcttacattgattttgtaatggaagactggaattgggattaatgcctatggacttaatgacaatagcttctgttgcctttatagctgtcgttattattgatttaattaatgatgatatgagctatatgttaactggtactgcaatattaataaacatttgggcaggtttttatggatggttctttttactacaagcaggtatgctacttttcttactcttagctagaaaagttaaagatgataaggaatcaatactatactcaggtgcttcgttaatatgtgcattagggatgataataaatcttcttatattttcttaaaaataagtgttgacacttctaaacttttgtattatactataagtataacaagtacaggagatgattaatatgagtaaagaaacaattagaagacaattttcaaacgcaattgagattatggcaacaactaaggaatggtggaatttccctaaaagctttaatacaaataaagagtttaaaattaaaacttttaaaaatgacacacttgtatttgaagttcgagaaggtaatagaaacttaggaagctttgtagttttcacatgtattgactttgattatgataaacttgaaggaacttcaacacagtatatgattaattactttgctaagaaattaactaaagatatgtttaactatcataagttacaactatagtaggaggtggaaagatgagagaggaattaaaaccttttaatagaaaacaagttaatgttaaagggtacttagatgatgttaagtactcaaagcgtagaagacataaaggtaatcaacatggatgtgtaaaaataacagttactgacgtaaagattaatggtatatctattgaccatgttaatattgaagttggaatttctttttatgaaaaactaaaagaattacaaggaaaaagaattcaatttgtaggtactgtctacaaatacgttaaacatgctagaggtcataaaggtagaattaaaggattttataaagaggattatagtgtaactttggataagaagttacaaaaggaggaaaaataatgattaaaagaagaaaacatttagaccatacagtacaacctgagaaaggatggagaacagtaccttttaatggttactatgaagcccacccttcaggtttaattagaaataaagtaacaagaaaactaattaaaggaacacagacaaggaaaaatcatcctaagtggactgctcatgagattgtatatttaattaaccctaagaaaacaagttattcacgaggtgttgttattgcacatacctttcctgaaatgattagccaatcacgaggagaccttaagaacggtcacgtatgttttaaagatggtgacagaagtaattgtcatgtaaataatatgtttattggtaaaggtaatgttaataagaatatctacaaattaaatgattcctatttgactagaaaagatattgaagaggatatcaacaacttagttaatgagagactattctctcagttagagttacttattaagaaaaatgaacctgaaagaattacacctagcaatcactttattaaaagagataataatgtattcagtatcacggatttatctaaaaactctttagtagaatttgaattagaaatcaaaaatattaaataaggtggctatataaatgaatgagtggtatgctttatgttactatgataaagtaggtaaaaagaaaatacctaggcaagttagagcacacagagatatttcagtattagaagagctaaaagaaagattagaagaaagaaatcctagtacagaatactctataaaaacaacaaaagaatttgatgaggagagatagggatgttaacaccacagcaaaaagattcattaaaaaagcaacaaaagaaattaagtaaaaagaagaaataactgttgacaaatgagtgtacataggttatacttaagttaacaaataaagaggaggtatgacctatgttattcataatttttttcttagcagtattctttgtattaggatttattaacggatggaactcagaagactaaaaaaggagtggttatagtgaagttagaagataaagtattagaaagaattgattctcttggaggtaagttaggtgatattagccaacatgcttgggaagctttagtaaagtatcaaattatatatggtattatagaccttatagtaggtattatagttatagcattaactgtatttttatggaagttatttattaaccaacataaaaaggtaaatgatatagatagagatgatgattatagtttactatttgaagattgtgaagatttatcaggtataggtttgttttatgtaatagctacatcaatcatatcactatttgcatttatatacttagtatatggaatacctatggatattataaaaatactgaaccctgaggtatttgcagtaaaagatttaatcgaacaagctaaaggaggaaactaaaatgaaacaaagagattttgaatttgaggaagattttgtattaacttacgagtgtgaggattgcaaacattttgaagattggggtcatgatgaagagcctgaagaatgtagtgaatgtggtagtagtgacttaattaacaatacaagtcatgaagacactgagtgtgacatgtgtaaagggtacattgatatgtggcaagatggatatagatacatgggagataataaagcataccttgaaaaagaagattcaggtttaatttgtgaagattgttatgagaaattagatatttaataaggaggaaattaaaatgaacaaagcagtagagcaagcaagtagtgcattagggcaaggtttttcagctatggtatggcaccaggtgttagtaggtttaggatttattttactaggggtgttattatctttattagtttgggtactagtaaaaaaattacaggtaccatttaaccatccaacagcttttgtagtatactcaattatgttagttagtattgttgctagttttatttggggtggtttacacgtaattaaccctgagtattatgctattttagaacttaaagggtttataaagtaggaggaattctatgactaaagaagagttagagcaaagagtaaaagaacttgaagcagagaataaagaacttaaaaaacaaatagaacgttttgaagacgagggaggaaaaacaaaagatgaatagtagacaaaagaaaattctaacattaacaataaataattttttaatgttagccttagatactgtagcactaattagatataaaaaaggtaaaattaaacaagagaactataatacaggacagattacaagaacaatagttacaacagctaactcattaggtattctttacttagaagaacaagagcgtaaagaagttaaagatattaaaataggtacttttgaaactggagaccttaaaagatttatgaatacaaataaataaaaagtttaagaaacctattgacattaggtttcttttattatatactaatattataagaaataaggaggttaacttatgaaaggtattattatattttacaaagaagagaccaaagaggatttaggatattttcttgggtttataaactttaagctagaaggattatcttacacaactgaaggtactttagtagataatgatgtagtagttttaaaggataaccaaattaatgaggataatttagaacagtttagtatgtcaaacaataatttagttattggaatactaggtcattcatctctttcagtacgtatctatgaaaaaggtattagacaagaaattgaaagagtagaagaatatttagaggagttgagacaataatgttagcaatatttgcattaatttttggtttactatttattttatctttattaggtatttttatttattctatatttttacgaaagaaaaaacaattaatagaagaaagagaatcatttggtatttataatagaacgaaagaaaaactgggtgatgtaacacgtttagggtatgaggaagatgtatataagttaatccataaccaatctaataagacaatcatagaggataaaaagagtaaagttgtagatacaattaaaaagatgtatgaattagaattaacatctgtagatgtttctaaggtagaaggattatctccactcgatacagaacctatgacaaatatgaaattactttcatataagctagatagagaaggattatatagtttgagtaaatttatttaggagtgatacaatggaatttatagataaaaataatgtgattaaagcttacgatataccaaatgtttatttaaaaggttatgtattacaggcatgtgataaaaatggagatacaacagcttatgatggttatgaccaaatacactataaaaaaggtagagtattaacattcccttttgataaaccattaagaaagataaatgtactatcaggatattacaaactatttaaaaaggaggacataatatgatttattttgttagtgatttacattttggtcatgataatattagagaatttgaagcacctacaagaagtcactggaactcagtagaagagatggatgaaggtttaattgagttgtggaataatacaattacaaataacgatattgtttataatattggagacttctttttcaatatgaaaccgtctaaagtagaagatatacttaatagactaaattacaaagagatgatactgattgcaggtaaccatgaccataagaaacttataaaactatatgaacgtaatggtattacagtaaagtacgcagatatgattaaaaaggatggtaaaagattttatctaagccattaccctacgctaataggtagaaaaaacatgtttaatattcatggtcatatacattcacagttaatggatacagagtatcacattaatgtaggttatgatgtagagggtaagattgcctatagttttgatgatattataagtagagcaggtgaatataatggagaaattcaaaggtaaagatttatataaaactagaattagaaagcaaacaattaaaaatttagttataaaaacagagaagctacataataaacatggaaagtatagacctatcggtcatgtctattattacccgaaaacaaaagagtttactttatccaaacctgagcagaaaatatttatagagtacatgaaggcattaggttttagtgttaaacacaagagacgtaagaaaataattatagtatacaagaatgtgttagatgaatatcttagtatgtatcaggaagcaattgaaagtacgtgttgacaattaaggtatactatgttatagtatagaaaaggaggttaactgatgaagcattttattttgattttaggaattgtaattctagttattgcattaggtattgttttacctgcatggattttacaattagtgttatctgcatttggtgttaaagtaagtatttgggtatgtatcgggatatttatcttaatcagtgcagtaggaagtatgtttagtagaaattaaaggaggaactataaatggcaaaatatgaatcaaatatcaacggagaaaattatattgcaacaccatcacaagctttaagagaggcactagcagaattaattaaagaagaaaagaactttgcagattaccaaactaagggtgaggaacagtatgaatcacagttacaactaagacacttcgatgcaatgatttctcagtatgaagaagctattcgagtattagaggatagatatttatctcagatttttattccaaaagataataaggaggaaaagtaattatgaaagcagagtcaatagcacgattttttcaggataaggtattacaaatagaagggtataaggtaagattcactcaagctagttcatcatatattttagatatagatactatggatgaatcagtattgtttttagatactgtagttttcactctatcaggcaagtacttattagatacacatattacgattaataaacctgaaacactaagctctaaggaattatacacagagattggtaataaactacaagagattgtaggagaccaaacgaaaacagatatcgaattaactcgatactttaaggaggtaaaataaatgaaatcagatgctattataaattcattattaaatatgaaacatataaatatacaaaaacacaatataaaagtaacacttgagaaaggtagatataagggtgtagggtatctaatagagtttgaaacctcaatacaatacagaaataattataaattacaatctccaataattatatcttacgaaaatgaagagcctaaagaaatcattactcaaattaaagataaagtattgaaaattgtagaagagcagataaagacagatgatttatttattgaagcaattgatgatattaataaggagacagctcttagaaaactaaagccttatattaatgaagaatactactcagtgtttaaatcatctattgataagggagtacctgtagttttaccttctgaacttttagatagatgcacaggaaaaacatcaacaatggcttatttagctatagaatatgatttacctcttatagtatcaaacacagtcatggttagagtgctattaaatgattatccgactattaaagttacatcgaaaaaaagagaaggttacaaagactcaatagtgttaattgacgagcctgactctgaaatactaaatctttacttaggtatgcctgagtgtgatattattggtattacgaaaaaataaataaatttataaatacctgttgacaacaggtattttttatagtatactttagatataaagaaaaaggagaggttaacatgaataacaaacaaattgaaagattacacaagaaagcaaacgaggtagtaagtaaatcagaagatattgaagatttaggttatgtgcaggcacataaaattattaaaggatatcttgatttaccagtgtctgattttgaaaagagagatgtaatgactgaattactattagcgttagataaagctaataaatctatagattaataagggggtagtaatatggtagatattataattttaattgtcggtttaatattatttttagctagcggatataaattagttttaggtaaatattatgataacacagatttaaaaatgttatttacaatctttggtatcggtactatactattacttgtaggatttatattataaaggaggaaattataaatgaactataaagaagtactagaagttattaaaaagaataagccatgtaaggttagatttactggaagtattttagcaattgttaataaggaatttaacgcagatactgataaaggtgtgttacaaattgatgtatcaaatattaataaaaatgactacattaagttacaacagtattgtttagaaagagatgattatactgtagcaggagctattttattttaagggggagtaattatgaattatagagattttattacggattgtattagcgggggttataacgtccacattagtgttactgagaaaagagttcatattatttcagaaatgacatcagcatcttatccgaagaaagaaattaatttggatgaactgcaagcttatgtttattatatgaataattttggaagtcagattacaacggagggattataaatggaattagttattaatattatagcagtattaattggtatgtacggtatttacttttatgttacaaaatttagtactggtctatcaggtattttaattgtactaggtatggctgtaggtctttacttttacttagattacttaaatgttagagagaatgttattcgattagtatctgtaatgtttggtgctttcttatttagtatcgagatgatttataataagattatgttcgaaattaaaaaatctaagtatgataagactgttagaacgtacagaggagaccaataagaattttactataaagagtacttaaaataggttaagtgctctatatggtaccttaaaatggcttagaattgaaattaaggagatgaaaagttatgtatcctgatataggtgagttagcttataaattaaaaagtactagagaaagactagaaggtattatgatggaggaagtttgggaaatacatcatagagagacaggaaaattagtttttaaaggtggatacttagaagtaaaagaaatattaagaaaaatgtataaggagaatttaacattagtagatgtagacacaatgttaaatatcggtcaagggttttttgatgttgctaaaagtatatcagcagaaaatgtatttcaaataaactataaaaaggagttaccacgatgattaaagtattttcagaaatggatacaaaatataaaacgattgtaccggagaaattccctaatggagaaattaattttaaatatgatgacctaaaatatttagtagaaggagaactatggtttgatgttttctttaaatgggaaactgatgcagacttaatgcatttgtatatgtttactaagtatctagaacaattaggtattaaaaataatgtttccttcctggaaattgcgtatttaccttatagtagaatggatagagtagaagaaggtcatagcaatatgtttagtcttaagtatattgcagaatttattaacaatcttaattataaatctgtgttgatagcagaagctcatagccctgtcacagaaaatctaattaaaaattctgtttctataggtgtcacacttaaattattagaccaatatattgaaatgtctgaagaacctgtaacaattgtactaccggataaaggagcttatgacaggtacctatctgatgtggaagacatcttaagggattccaatattgaaaattattcaattgtatatggtgaaaagaaacgtgattttgaaacaggtaaaattaaaggtattaaaattgttaaggataaaaatactttatatgataactgtattatactagatgatttaacaagttatggtggtacatttgtaggttgtaaaaaagcccttgacaatcttaaggtaaatagtgtatcattaatattgacccatgcagagaaagtatttaaaaacggtaaattactcgattcaggatttaaagatattattgtaacagactcaatgttacctgatagccagtgggaaaaagctattgctaaacatagagcacaagaaaacggaacagaattacaaataaagagtatcgaaagatatctataaaaggagaagaataaactatgctaaatccaacattaatgtgtgacttttataaattaagtcacagagaacaataccctgaaggtacagaaattgtatacagtacacttgtacctagaagtaataagtactatgaacatagtgataatattgtagtatttggtattcaatcacttgttaaaaaatattttattgatatgtttaataaagaattctttaatagacctaaagaggaagttattaatgaatataaacgtacagttaaattcacattaggacaagaaaaccctgacgctaaacatttagagcagttacatgacctaggttacttacctattgatgtaagagctttaaaggaaggtacagtagttcaccctaatacacctgttatgacaattgaaaatactcactcagatttcttttggctaactaactatttagaaactattattagtactcaaacatggcaagcaatgactagtgctacactagcatatgatatgcgtaaaatgttagataagtatgcattagaaacagtaggtaatattgaagcagtagatttccaaggacatgactttagtatgcgtggaatgagttcattagaaacagctcaattaagctcagcaggacatgcaattagttttaaaggtagtgacactgtacctgtagtagactttttagaatcttactacaatgcagatgtagaaaaagaaatggttgttgcttccatccctgctactgaacattcggttatgtgtgcaaatggtgattacgagacaatggatgaatatgaaacatacaaacgtatgttaacagaaatttatccaacaggagtattctctattgtatctgatacttgggacttttggggtaatatgactaaaactttacctaggttaaaagatattattatggaacgtgacggtaaagtagtaatcagacctgatagtggagaccctgttaagattatttgtggtgaccctgatgcagatactgagtatgaacgtaaaggtgctgtagaagtactttgggatacttttggaggtactgaaactgaaaaaggatataaagtactagatgaacatgtaggattaatctatggtgattctattaactatgagcgtgctcagcaaatttgtgagggattaaaagcaaaaggttttgcaagtattaacgttgtattaggtgtaggtagtttctcttatcaatttaatactcgtgatactcatgggtttgcaatcaaagcaacatatgctaagattaaaaatgaagagaaacttatctataagaatcctaaaacagacagtggtaaacgttcacataaaggtagagtagctgtttacaaagatggttcatgggaagataacctaaatcttcaccagtggttaaataaacagaatttaaatcaattagaacgagtatttgaagacggtaaactatacagagaccagtcactaagtgaaattagagaaagaattaaaaataattaataaatatttaaactccctattgacaaagggagttttttattatatagtataactatagtaaataaaggagtgaaagagatgatttataaaatatcaaaacataattattatagtaggtttgagtattctacttaccctcctgatgaagggtttgcgtatgtagattatgtagatgtgattcttatcggtgtagataatcctaagaaaaaaaaggttattaccttaaaagtaaatgagttcaattcggatgactataaagtaggtcataagtacaatattataaaaatactatggtttgaaaaatgggaatggttaaagccataagtaaaaggagagaaataaaatgattatagataaattaaatggagttaaactagaaataagcggtcatgtcgtatcatttagtgtaagaaagtttgatacaattaatggtgagagacaattaatagactaccatcatattaaaagaaatagacaaaagtactttagaactactgaagaattttataatgaatataaagaaattaagcctgacaaaaatgaaatagatgaaatgtttgaatctctaggttacgtagatactgagttagatgatgtagtaagacacctggaaaaggttactgaaatattaggagttagtgaacaatatttaaatcagttatcttataaagctatagaagagtatgtagataaagtagttacacttgaaattaaagagttgaaaggagagaaatagcatgaataataactgggaaaaagaaagggttaactattgggaaaacgaagactgtccgagggaatacttagaaaaagcattcattgacctagtagaatatgtcgaaggagttacagtatcatctaaagatgttaagcagttaagagaagataaacttagagaagatattgggttttatgagtacgtagctgataaataaattagtatctacctattgacttaggtagatatctattatataatagtatacaaggagatgaaaatatgaaaaagttaatagtattacttacaattactatttctctattactaggaggttgctctcctgataaccatgagggtaaagtagtaggggtaggtgaatacagagaaccaactacttatataaaatcaggtagcgttactgtcccagtcattggtgaaatgaaatattatgtagatttagagacagataaaggagaagaccgtgtatatcttaataaagaggtctatcataagtttgataaaggtgatggtttctctaatgtaggtaagaaagtgtacaagaatgatgaattaatatataaaggagactaagtagtatgacacaatttatacatgataagaaagatagttataatagtacaaatcgtaattttgatactcaatattataaaaatatacctttacaacaaattgataggggctatggtcaagcaaaagctaggaggtttacaataaataatacgaaccaaaatatatggatacctatgacatatttaagacctaacggtactcttaaaaataatattgatatagattggatatttgttaaagaaaaaaatagtttaaagaaagcaggattagaaataaaaatagaaattacagaaggtggattataatgtatatactagagagaacaattaaaggttttgtaggtcaaaaagatgatatcttaccttattacttcagaagtaaaagggaaattgttcatttcttaaaattaatggaattccgtaagaaagaaacaaattattgggttaaaaagaatggtgattttactattataataagagctaaaaaattattatatattgaagaatatatacaaaaactaaaggagtgggaaaatgacttatgatgtgtttgtattatacaaaagaagagaacctattgcacaaggtagtatggaacattgtttagatgtctattattgggaaagattacatggatatagtaataaagggtatgagctattacctatagaatatgaccaggaggaacaattatgaatagtacaaaattagtagattattttacaagtaaacaaggtaaatatctaatattacctgatgaaactaaagttaggttatctaatgtagatttaatgtcttacattatgagactcacttttacttataacacagaagttgtgtctatagatattgataagttatactcagattctatagaaatgcatataccacaaggtctttatatgacaactgttgttaaaattcctaatacacagagtgttagttcagttcttcataaggtattagaggaatgggtaagacaagtacaaaatgatggtatattcggattcgtatgggaggaattttaatgtatagatttttattgtttagctattctgattattacccttgcggtgggatggatgatgtagagcttaagtttaatggtttttctgagttaataagtaacaaagatgatttgtatttaagtgaaaatattgaaatatacgatactaagtatgacaatatactatatattagtaacaaagaaacgatattaagtgaatttagagactatttaggataatggtaaaaataattaaaaaataaaggagaaatgtaaaatggcaagagaagctaaacaaacagtaaatacattattacaaagatacagaacagcattaagagcaaagaaaattatttttaacttaacagatgaccaaattgaagaaatggacttagaagtaacacttactacaaagtatagtaatagtgtgacaaatcaggtaattaaaggtactgacaaggatgtttcaatgcttatcctgattttaagtaacgaagaatttaatgataaggttattaatattgaaattgaagaaatcaatattattttataaaaactttaactctattaagagaagggcaactagtatttaattttaaatgggaggaattaatatgataaatagatataaaaaggtatgggatgaaataacccaacaaattgttaatgtagaaattattaactttaaaaatgaaacagtaacaatagaatctacagatgattcaggattatcagagataagaggttttgaagaagtagagtttatagattactatggataagatgtttaaagtatataatttataaggaggaaacatatggacttgtttgcaaaaataattattatgtctataggagttgtccctttaattacatttatggtatgtttagctataacagattattataatagacattaggactaataggagtatgttgactaataaggaagatatataggagaggagttaatcaagtaaaaccaataaaatcaattaaaaccaagtaaagtaactaaacaatacctagagcctgggaaaacttttacctctcccactcagcctattacttactaccgacttccctaactatgtattctatagttataatattcatttattatacaatacttaaactatagtattgtaaccttaatctatactgaagcggtattaatctattgttattatataataatcttatataatggtggtataatctaggttattacattagaatcattctaatctagaattttaatctttagaccctaggaaaagtggtactaaaatatagaaccctataggtatgggattcttatttttaaaattactaaaaagtattaggttttccctagggtaaagttttaatgtacctaaaatcgtaagtagctccttatcatttaggtctgtttaattgagaatattagaagatatccgcttcaattacaattaaaggttgacaactatgaagcggtatgttatacttagtattgtaggggtggttccctacagacctagactatggtcgtgattttggtttgcatattagtgtcattcataacctctattccagtaggggttatttttatttaagtgttgacatactctaagtagtatggtatgattagtatataaggagatgaataatatgattgatatatacttaggggaaaactataatactgattacttatctactattatgaatattataaagacttccgcttcaagagagttaagttatgggtttaataataaagaagcggatgtaaatatagaggatatgaagtatgaaggtgatgttctgcatgtatatggtacgatgtctatggattatccaggctgtattattatatgtattactagagatgagactaaggttatacatggtggtaactttctaacaggtacaggtcttagtcaagaagttagagaaaaattctagggggagttattatgattataccattaattatattcatgatgaccttcggtacatttgcattcagttatgttgcacatgatgcatacaaagtagatgaaaaaggtatcatgtatgctatggtagttggtattgtagttataaatgggattggtttagaaatgataattgtagaatgtttataaaggaggtagtaaaatgataggtcaaattatactattagctattgttagtatagttacaataggttgtgtaggattatttttctatgagacgttcaagagtattaagtatgatgctaatgataaaatctttatgattactgggagtatattaatgttagttattatcgttagtggtgcattagctatacttggcatttagagctcatttaagaagcggttaagtagttcatgataaattggtctagaaatatatgaccgcttctctatggaaggctgagagggtttagaattgaaaggagagatataatggctatattttttagtattttattattgattaacatatacttaatatactatgaatgtacttcagttacgtttgattggtgtgcactgcttatttacgtatgctcattatgctcttgtatttatttaatagtatattttgtataaaaggaggagatataatgcaagcaactatatactgtgctaataggtatagtaaaaatacattaaagagtcttttagaaaaattagaagcggagaatagaaacttaacatatagtactgacatatcagatatggaggaagtggatgttattgtacaacacactgacttatcttttgcagagttaatggattcttgtgatagagtaagtaaagggtctgaccgcttccaagtatttgtaggtaatcacgcagggtattatataaacggtgatttatatattaacgaagtaggtaagtttattgtacctaggaaaacgaatatgatgatgtaaggaggaaatataatgattcatatatttgtaaaagaggattataataaagaaacattaaggagtttacttgaatatattaatgatactgtaggtagggaattaacttatggtattaatacagactatgataaggatgtagtgattgaaaccgatgaccctatagatgaggagaatacgattgatttatcaaatcttcctcactttaaagatgacttatgtattcttatagaagaattatactgtaaggcatttgttaatggggaacctattattatacgtaagtatgtagaggggatgttataatgattataatatttttaactgaaaaatatgatgccaaggctttaaagaaagtattagaacatattgataattgtagtagcagaggtcttagctatttaatgggaaaaggagaagcggatgtatgtatagagaagaatgtattcagagaaagagatgatgtaaggattaactcaaacattattgatgaaggtaaactttgtatactcataaataaaaatggtttagaatgtagttactatagaggtgtatcatgtaatattggtgcctttgtaaaggagagattataatgatagaaatatatctcagtgaaaactatgatagggatttactcaaagcagaattaaaatggattaaagagaccgcttcaagagaactaacttatgatgttaatagaagcccaggattagatgtacatattagtccttttagatataccaaggatgaggttgaagaaatgagcttacatcctcagtttgaagatgatgtatgtgtatttatagctgaaacatggatacatgagtatcgtaatggtaaatcaataggtgtagatagtatggaagaatatgtaaaggagatgtaattaatggtagaaacttattatacagtatatcataagaatagtatgaaaactattaaggattacttaagtagaagtgatttaattgacttcttatataagacttggcataaggatataagtaatatatacccaacagattatactacgtatgaaacaaaattctgtatagacatagatgtagttagattaattgaagcggttaatgaagaaggtgtattacttattaatgaaggtaatattgtagagtggtaggaggagataaatatgagtcagtttttcacgtatacagtgtatcatacagaaacagctaaagtagtagctaagaatttgtttgatgcatcattggtgcaccttattaacaagatgatagagaaagatatagttaaggatattaatttagaatattacatgaatacacgtggtgtagttatagatatgagtagactactggatgatatagaatcacagggtgtatttctattcaaacgtaagctacatggataataggttagaccctaaaaagtttgagatacaataggatgcttaggataataggataaaaataacttaggatgcttaggatgaaatacgatacgatagggaggttaagttaagatgcaagagttaataacttatataatttaccataaagaatcaggtaaagtagtagcacaggatttaagtgaattagaaactattgaacttatatacaaaatgatagaagagggattagtaaaagatatagaattatctaactaccgtctttttagtgggaatatagatatacttaacttattagtagacatacgtaaacaaggtatatttgattttgaacatacttggcacacaagataaggagggataggatgatagttatatattcagatgagtctagggattacttaagagatgagttcttaccttggcttaatgatagagatagatatttaaaatattataagaatgagttacctgaagatatagactcttcttatgttgtatcagttgtatactgtagggatatggaaggtcttatgaataggaaagatattcttattggtaatagttatagagagcctgtagctgtattaggtgttcctgaattttttggtaactattctaattattactattataaaggagagcatataagtaagcatgacctaggagagataattaggttaaaggcttggcaacgtaattttgactaagtagctctctctaatttcactaagtagctccctaggaattgcctaagtagctcggtgtgattttaccctaagtagctccctctgttttctattagtttattttaaccgcttcacgtgtctatatatagacaatcggaataatagcagaccgcaaaaagaaatacactaggatattattcccagtgtattgtataatttttttatagaatatttataacattgtattcaaattcatttacttcatgttgtgatttaattaaatttttaattaatccgttttgtgttttatagtcttttactagtttttcattttctataattaaattattaaattcttcttttgttgtatcctcatctacataaaatttactttcatatatttcataatattttttatctgttccgttatcaatatcatctgatatttgataatttttgaatacaatttcttttgtttctaattcatttactaataattgtgattttgcatattgtaatacgtcttcattgtcccacattggaatatagtttattttcatttaaatcaaatccttttctataatttttttatataatatttgtagaagcggttggggtttgtcccttgccttactacacttaatatattacagtatagttattcagaagtcaatacttttgagtaacttttttttaaattcttttttcttctatataatagtagtttttagccctaaaaaaagttttttaaaagaatttacattttcttattgacttattaatcatatgatagtaatataaaggtacagcaagagaacagcaacaaggtattagaattatataaaaaaattatttaattggagatgatttaaatggatgtaaaagaaattgcagacactataatggagttgtggcaaatggacggatacagatgtacagaaccgccattatatgaaagcacattaaaccacacacgcacatatacggctttaatcgtaagcattaagggaaactatgacactgttcaaatgttccgtaaaacgcctataatgagcatgagagggcaagcgcaaccggctagcatgttagtaaatgtaattgatgacgtgattataatcgtatatgaaaatacggtttacggggtacagaataaagaaataaaatttattgaagaaatttaaaaataggggttgcaataccccttaagatgtagtaatataatagatgtaagggatagcaacacaccttaaaaaactttttaaaaaagttaaagaaaagtgttgacaccttacaagatacatgttaatattagtatagaagttaagacaagccacatagcaaataacgaaattaaataaaaaaattatagaataggatttgattattatgacaaacaaaaattacttatacgaagaaactcacacagtacaagggcaagacattacggctttcagaattccaaatgacacaaacggcaacccacgttatgtagtgcatttcatggatttagacattaaactagcagactatgacaacatcaataagctatacggatttaaaaaatatactgctaaatggtttggcggtggtgtagtattccaaagctataatattgaagatacattaaattacgcactatctaatgttaaagaaatagaagcggttaagaattaaaaccgcttctgaattaaataaaaaaattatataaaaaggatatgatattatgaaatttaaaatagaaaaaaataacagtgatataaaaactttatggaatttagctaaaaatggatatatgagttatcaaactgtacacaatatatttaaaaatgaatcagatgaatttattatatttaacagtaaacaaacttataataaatttatggaattaagatataatagaagtgcaattcaatagtataaaaaagttatataattccctaggattaaattcctagggatttttatttgttttaatttatataaaaaaattatttaataaataaattagtgtaaaattgactgttgacaaggttgtattttttatggtataatgaagtgaagaccttttttagtataaaaaaattattatataaaaaatttatattaaatggttttaaaaccgctctttctccccaccttgtcatatttatagtggaagggttaggcgggttaccactgttttactttctatatatagtatactatgaataatggtaattgtcaacacctttcagaaacttttttttactttcttttattattatataaaaaaattatacatattttagggctccacttccattatataataattcggtcttaatgtcaatacttttattcaaaaaagttttttaaattaatttcaacaaatctattgacttatgtttttttctatagtaatatataggtataccaacaagggaggcaatacaaatgctaaaatttaaatggaaaaacaaaacaatcaaatcaactcaaaaaacggataacattattttacttcttataggtggtttagttgcaacagtcacgcctaaacttgtaaactggtttttactactacaagataatataaatatttttttaagataactattgacaacttagaaacaacgtgttaatattaagatacaaggtaagggaagcggttgaccgcttccgacctaaataaaaaaagtttaaaaaaactattgacagtcacttgaaaccatgatattattaagataacaaaaaacaaacagaaaaggaattgattataatgaaatttatcaaaactatcgaaaacttattagaaaaagcagaaaacaaagggcaagcaattttaaacggtcgttactttgacgggtatagcaaaggtgagcttgaggaaaaatatgcaattgaaattgatggcaacaaattgattatgcgtcactggggtacacaaacaattgagattgacttaagcataaatgagattgtttcatattacggtgaaagcaattcagaccgtgacagtttaaacacacttgtatattgcttaggaattgcgccaaactttagatacttaccaagcaaaaacttattcatttatgaagattaattttaaaataaggcttgactctcaagccttaccatgttattattaaattgtaaggtaatcaagcacacggacaaaaaataaaaaaaaagaggttgattaaaatgacaaaatttaacgtaaacgtattagatatagcggtaacagaatggaacgaagaatatcaagattggtcgggggatacgtttttcaaaggtggttttcatcttgggacttcagaatcaaataagcttgatgatgttctagctacagtaaacacaatgtttgatattagcaaatacggttcagaaatagacgaagacgggtatctaagatttacagtgattgaagatgaagaagctatgcaagacgacaacggtcattatttagttgattacattgtagagattgaaaaagttgaaaatgtaatgattgaagaataacttagaagcggataaaaccgcttctttttttgtgtaaaatttcctattgacaaatcatatcaaaatttgatataatggacttggagaccttctttagtataattttattattcaattgtatacaatactataataaaattagagtaaaattgatacttgacaatatgtagtaaaaagtggtataatgaagtgaagactttttttagtataaaaaaattattatataaaaaaattatataaatgaatttagttcggctttttcccgatacccctcttgggcatctttggtatctctacaattactattatacagtattataggaataagtcaatagatatttaaaagaaattttacacttttttcttttctaaaagtgttgacaattttatatatacatagtataatatagatataaggttagggaagcggaacacctaaaaaaaagaaattaaaaaacttttaaaaaggtgttgaccttcaagccttatcatggtatacttagtataacaaatcaaacagaaaaggaaatgatgacaatgttcaaactagaaaacaaaatcgaggtaatcgtacctaagcaagacaacaacggaaaagagattgcaagccctggaattaaagaagcggtaaacaaagcaactagaattgcgggaggttgcacaatcactgaggttaaaggacagtggtggtctgacgatgagcaacgtatcatggaggacgacaacttaaatcttgagtggtactatgacaaggatatgcaagatgtgaacgaccaacaagggttattacaagccatttctaaaattgctagacagttgattgttttttatcaacaagaagcaattagcataaaagttaatggtgtgctatacattgtagaatatgaagatttaagtttattatcttatgagctacatgatttaatgttctagggatttattccctaggcattatataaaaaaattatacaataaaggaaatgataatatgactactctattaaatacaaatgattcagaattaaaaaaattaaacaactcaaatgtagaaattataaaacctttatctaaatcagaatacgattttaatgattcagaaacttatatatttatctgtaaggttgataacaagactattcaattatttgaagatgaaattttatttaaataaaaaaattatacaataaaggacggattaaaatgaaaactgttaaaattttaaaaaatgtagaattgactttagcacctattcataatgaattaaatgttggacaatactttgataaatattatacaaacgtgtacaagaatattacagtaacaaaaattcataaacaaattgaaactgatgtttatgatagaaaatatttaattgatgcaatcgaagttatataaattttttatataaaccgcttcttatttaataatttgaagcggttatttctttttgaatatgtgcttgacaaatgtacgaaaaaatgagataatgaagtgatgactttttttcgtataaaaataatattatataaaaaaattatagataaaaataccctccacgtccattatatcaattttgcccccgcttgtcaatacttaaattaattaaaaaagtttataaaaaagtgttgacatttctttcaatccatagtataatatagatataatgttaaggagcccaagaccaaagaaggggtttcaggggtagaccgtccttttttaaaaaaaaataaccgtccacctccattatataataatttgccccttttgtcaagcgttttacttaaaataatttatttaaaaaagtttcataaatctattgacttttatatcattatactgtaatatatagagtgtagtaaggaagcggtcaaaacatcaaataaaaaaagttttaaaaaggtgttgacaaccttccaaatacatgttattattaaggtagttaaaaaatacaaatcagaaaaggaattgatgaaaatgacaaaaacaaatacatttaagcaggtttacctaaattgcctacaggacgtaaaaaacgacaaccaacagaaacaaatcgtaacagtgtacttggttaaaatgagcaaaggaacagtccacacaagccaattcgtgatgacagatgacacaagctttgaaacattcaagaacaaagcaatcaagaacatttgggaagacttcacacaaaacttgaaagacatcaagcctgaaagcaaatacagaattaattgcaaataatttaatcaaaggggttgacattcaacccctaccatgttattattaagataacaaataagagagggattgataaacatgaaagcaaacattaacatttcacaaggtgaaagcactaagcaacacgtagaaagcaaggtagctaaatacttagctaagcaagatagagtggtctcaatcaaggaggtttacgaagtcttaagcctgacagatgcgacagtttcaagaatgactgaacaaggctttgagaacattgcaggcggtcaaatcatggctcacgctatgaaatttatttaaattaaataaaggggttgacttccaacccctaccatgttattattaagatagttagaaaaggaggtcacacaaatggcaaattcaaacttaggcaacattcaaaaaatggcggacaaattaatgcccccaccaggttggaaaccaggcaagaaaacaagcaaaaagaaataaaaaaaacttcacagaagcggttgacaaactaaccgcttcatgatattattaatatatactaaagaaaaggaattgataaacatgacaaacacaataaaaggatttttacaaacagaagaagcaagcacagtaagagacgtagcaactcacggagtacaaagcggagcaattggcagattaatctacacatcagacgtagtaaacttctttgatagatacgagcaggacattgaagaggtaatcactgactacttagaaggtgtcacaggtgctcagtattatgacttattaaactacgagcttatgagtgacctagagaactatgcaaatgtagagtttcaacatgaggatacttaccacgaaatcgagtttgacctagcagaaaacattgcttcaaatgaaattgagggctttgaagatatggacgaagaggagcaggtggacgcaatctacgaagctatggagtttatagaacttgaaattcaagacactgacaaggtgcagtttgtgaacttagcagttgagattgtggcacaacaaatgcaggaagcataagaccctgcaggaagcacacagagacccacagaagcggattaatccgcttctaatacaattaatcaggagatggtaaagcatgaacacaagacgggtaaataaagcgttagacgaagcagttagattattagacaagcaaatagcagacacacagaa

SEQ ID NO: 2 - DNA, 167362 bp, Unknown
  Bacteriophage genome sequence derived from the Myoviridae family
aattttccttattaggccgcaagggccttcatagttttagcgatttgagaaacttcatcatcacttaaagagttgcgataaccgatgaagtcggaaacaatacggaatttcttggtaaactcagcaaccattttatcactgttttttgaagcattatttgataatacatcaaaaagattagttactgtccagatgtcatgaccgatggtaccttttccaccgttgaaatatacgccccgcaatgaactaactatattagcgagtcgtgtatattcttcagaaacttcatctgtactgaagtacttcatcataaaatctagttcaggatacttgataattttatcaatatatcgttgagctgaacttgaataacctacgtacttatcataatctacatcatcaaaagcatctacatataaatcacgcaaagcttcaaaaatacattggcactgaccgagttcttttacctttttctgtaaaagcggacgaataacataaaattcattaatgccaataagattagccatacgaatcaaaatattcatagatggatgacaaagagatgtagtaccatccatagagaaaatatcagaacgatgcatatacgctacataaccagtaatttcatctgcttctgacgtaagtgtaaacagttcctctttttcccagcgcccgtctttaatttcaaacttaaatgctgtagcagctttaggacgaggagctttacttttaactgccttcggaatataacttttaactaaagcttcaatttctgacaaataatgaatgttaacttcatcactttcaaacattgccataatatcaggaagtaaatcaatctgcgattctacttccggattaataaacagaagacgctcattatgatgaatattcaaagtgttattaaattcactatcatctaacgcatgcgctaatccacggacaatattaacacgatttttaatattatcaataacgatattaatttttgttgtattaataccaaacagacgataacttgatgcaacggctgaagtttcatggctttgcttaatgcgtttcagtcgagggtcaagatttacttcatacacaactcctgcattgcataacttactgtcaggttcaaacatgctctgcattttcttatatgacagatttttagtcgtgaatttgactgaattactaatcatataatctcgagcagaataccccatcttcatcaattcacggtatgtgtgacgaggagatgtagattctttaaatcgttttacatcttcattaaatgctttctcactaagctctttaactcgttcaataatatttttacgagtgcgatcatccaatgaaagagcttcacgtgatggagcaatatcaagtgaacccattggaaatttaatgtaattcacttcattacgaatgcttaaccagttacggtctctaataacaccatcgataggataaacaataccgccatagatagcatataatccaccacgatcaggccagtatctttctggatttacaccgtaatagtcatcaaaatccggaaaataatcaatttcacggtcaagaccattaataatagctaaatctttgaacggtcgcatgatataagaaacttcataagcaaagttgctaaaatctttttcttcaactggaactacaatttcaataccagttttatcatctggacccatttctttcacgaatgtaggtttaatttgtggaccatcgccatccatgtaagctacataaccacgaattttacctttatgatacgaagtaatactaaacgtatcagtataactaaacggagatttagaacctaaaccaaatccgccaatgaaatcgttagattcagccttagatgaactgaagtatgaattatacaaaccaggagaattatcatcaccctgaatatcaaaatcactcatacccggaccaaaatctcggcaaacaaatcgtggatctaatcgtcctggaacttgaatgataaatttttcaggatttccattaagagcatgggcatcaatcatgttggtaatcaattcacggaccactgcgcgaatcttgtttgtatacaaatcagatgatagaattttaaatactttaggatttgctgcgatgctaaatgcttttgatttagaaccattgccaagaatagtttctttttcagtggtgataatcataatttcctcattaattcatattgcgtttaataacttcagcaacttctagtagttcatctttagttgcggtgtctgattgaattttatctctaatatccttaaagcggtttttaaactcttcggcttctcccatatcgaaaaagcgttgaatgattctatattctcgatgaactgctttatcaaaaagttctaaatttactttatatgatttcatttcaatatcctcatttgcccaattaattataccacatccttgtggtaaagtaaactactggctcatccattctttgcgaaggtcagcattatctcccatgagcatttcaaaaagctctttccagttctcaggaagtttaacaacatcatatactggattttgaatcatctcacgatattcagatttttccaaagagccaagtcctttaatataacggatgctatgtttaggtagagcatctttggcactctcatattcagcgactgtataaaaccattcttgttttttaccgacctgagcgatgattacaggagttttgacgaagcgaattcttccttgttcaaacagttctggccaattactaaaaaatccgagcagagaaggataaatgcttcctagaccatcgtggtcagcatcggtcataatagcaatattatgataattcaagttttcagccttttcaccaagaactaatccagtgattgcgcaaatgtcaaacagttctttgtttttaagcatatcggcatatgacataccccagctattaagaactttaccacgtaatggataaccgccatgaagttctttatcacgaacatcaataagatatccgatagcagaatcaccctcagtcaagaaaagagtagtgtcagcgtctttaccgcaaagattcgctttaatatgtttatgaaccttagctttagaggcctttttagctgctttagtttctgctgctttttctgccgccaatttacgagccaaagcagcttcaataatcggcatcagaattgcttcattatttagaatagcgcgtgaaatctttttagcgtcaagttgaatatgactacgaatttcgccaaatggagaagtcaaacgctctttagtttgagaatcaaatcgcatgtttttcatatcacgaacaaacataacgatagtcaaacattctttaacgcgtgctttagttacatcaattttgaacttacgtttgatttgtggaataaggtcttcacaaatatcatccataacacagtcaatgtgatggccaccattcttagtatgaatgttattgacgtatgttaattgacgaaaaccatccggtgaacgaccaaccgcaatagaacaattttcttgttcttgaacgatagcatgttcatcatattggcgtgcgtatttcttaaaattaccctgaacctttttaccattaaaggtaaattgaatatcaggataaacaacagcaagtgtttggagacgatctagtgtaatgtcaagataaacttgggacagctcattagtttcaaatgacataaaatcaggaatgaaagtaacacgggttcctttccattttccaggaatatcttcccatgatttattttccatgccgtttgaacaacgaactacaatattattttgaccatcaccagtttcaccgacaaacatcacagaaaaaatgtttgtcaaactagaaccaacaccattcataccaccggtgacgcgttctttatcatcaccgaagttaccacctgcttttggaatagtccacgcagcaacaggaccaggaatttcttcaccggtaggtgttttaaccatcgcctgtggaataccacgaccgttatcttcaactgttacttgattatttttaatagtaacattaattttatttgcgaatttaaacttagtacgaataccttcatctactgagttatcgataatttcatcaataagcttaacaagaccaggtacatactgaacactttcccatttaccaaacagaaagcgctcatgcatttcattagctgaagagccaatgtacatgccgctacgctttttgatatgttcaatatcgctcagaattttaatttcattcttaatcatcacttatcctcgtttggtttcgggaatattatactccagtaatcataaagctaaaggcccgaaggccttttatttaaaacgaatagttgaatccttaaagaacaacccagaacatactgttccttctactttctgcccggtaggtccaatagcacgaaatccagtatgttggaaatcattttcagagcaaccgaaccagttatatccagtgatttcaatattagtaaaaccacttgatgataaaattttagttgcattatcagcatcagtacatcctactaaagatactgctaatactaatgctgcgatagaacgattaacatatttcataattttcacttaaatttaatggcttgaaggagactaataattcttaaacggcttctttcatctttaactgtaaaagaaagagggtcgccagatttcatggtaatagtgcattcaaaatcaaaatcttctgtgacttcttcaaagaagtcaaattcttcatcataaattagaacattactctgaaaactgtgaagaatttttccatcatttccggatgctgtactaatcattgtaacattatgacctttcatatcttcaacgataaattcgcttgtagatattacagcattaatagaaccattcctataaatagcagacattagatatttcttttcttcgcctttgcgaatacgatacttcttaccgattttaaacataattatcctttaagtaagtcgtaaaatccgccattcacatgcttaggagcagaaggccgacgagtagacaaacgatgacatttagggcaaacatcattttctcgttcagaaatctttttaattttttcatattcatgcccgcaatcttcggattggcatttataatcatacattggcataattattccttaaagtgtgctttcagcatttgatacaaggaccatgcctgttcattattttcaatagtaactttcatgacaggaaattctgtgaaatcttctatttgttcttgctcttcctgctcttgctcttcagctgcctgatatggattttccacttcatcaaagaactcagcttcgttagtagagagccagataaagttttcgtcaaggatatcaccatgtgttgcatatccaattgtgccagtaaatgacataattttagtaggacgaccaagatggtcaacatctaaaattttaaaaggatgcatacctaaacgtcgtgcataaattccgttatcagtatggtctttaataaaagcttcttgagcttgtttatttttaaattgataccatttattaacttcaaatttaatagccattaataaatttccttccagtaagttgtgccatcttcagtaatttcacgaaatacaccgtaaattggttgtttatcaccaaccttttcatacacataaaccgaagtcaagtgagtaaacttaacggtatgttccttttgaactactaccaaatctggatcgaataatacatcttcaaattcgtcattagtgcagttctgaacaattttacgtttcattacaatttcctcattaattgaacagtggagcgatgcgtttcagaagagtagcagcacctttggcaaattttacatcatgaaaaacagtttcttcttccgttacaacacgagctttaatgttttcacaatcccaatttttgcgaacaatcttcaaaagctgcagtaaatctttacattcagcaatatcgataacacatccacgagaatcttccattatcgcacgataaccgtaagccataccataatcattgaaagattgctcgatgataattaaattttccattttattctccaagttgttttctgtatcagtagttgatattgatatagtaccataatcaactactgatgtatatagttttatgaaaaaattttaaactttatgcaaatttatgctaaagctgcttcgcaccattttttaatttggaattcaggaactaccatgaactggcctgcaaaaacaatattgtagagcttgacaccatcttctacccaacggtccgaaataaaaccagcgacttgattcgttgtccatggagttccatctgttgccgccgcaattgtgaatttatggtcttttacaactaaaactgaagaacaaagtttccatttaaatgcgctttcttctggctcaatgaactgacttgagacataaccaatgttaccatcagcgtcacgaactttaacctcgttacgaccaaaaactggatcacttacagaaagaacttcaaccagctttcctgcaactttagaacgagaagcaacggatacatatacgtaatcaccagtagagagatttacaatattcataataattccttaagctttacgaggagaagcataacgagtgatttcagattcttcaacaacccggaagtcacctaagaatacgatattgtagagcttttcaccatcttcaacccattggtctgtgatgaagccacacatcctatcagttttacttggaccagcgaaatcatcaatataatcgaattcttcatcagttacaaattcaacgcctttacacaacgcccatttaaattgtgcattagactcagtggattcaacttcttcaacagaagcaaaatgagagctaacacgagtttccagaaatttaggacttacgtaagcgtactgagtttcagtttttccagaactaggaatgattcgaactttaacttctataacacgaccagtaccattagtacgaagtcctaccacttcaactagacgacctgcagctttagaacgagatgcagacgatacacgcttaatttcaccgatagtaatcataatttttctctctttgttgttaagatttattctccatgagagccattataacaggctctctataaagtaaacttaattaaggatattaattactgcactacgtggaactacactaaaatcacctgcatgaacaacgttcagaagttcaacaccgtcttcaatccactgatcagttacccatccactcactggacctgcgaacggacgtcgaattgaaacagctttacacaacaaatcagtaggcgcaataggcttaaccagagtaccgtacatacaagcgatatccatatcaatacagatgtctttaacgggttctacttcttcaatcaacagttcaaagtcggtgcttggaagggcggtagtagaaattgtaccgtatgaatttttaatttctaagaataaccaagggccttcagcttgtttgatgaagttaacaatagtgaaactattaccttgagtggcgcctaaaatttcacaaaacttttcataagctcgcactgaagcaccataccagttgatttgcttttcgtctttcaggatgtaagtagctgtagtactgatattcatgatgttttccccttaatctaaggtaataaagccttttaattcggcatgtgacttgcggaacattacttgatgaccgccaatgataacttggtcatcaggtacttcgtatacagcgagataaaatcctttagaagctaattcttcacgctcttctcgtgtgaaccatctcatcatatcatattcgctagcgaaagcaaaatgataaagagctataaaccatcctggaatatagtgatctacgcctacatattcttctttctcaaaattagtattaattgctatattagcatttttaactaataatttgtcttcatgcggcacaggaattcttttattatcattactatgatgcataaaattaggtctgtcataacctacgtgtaataaccactcttcactccatgaatctattatactcctgtacggagttatttgaacacaaagatctcgacgtattgttatagcatcttcataattaagaatactaaatgatgattcaacacgataaattttcattttattatcctcagtagctatggtgttataataccacaactaaccgaggaagtaaacaactttttatcgttttgttggaagagacagaggatcgcactcttcctctgacggagcatcttcaagacccatagcgtatcgcaaagcatacttcatcatcaggatgtctttcgcacagtcatgaatagaatcatgcgcaacgaatccatctaaggttccctttggaagaggacatgttgtcatatcacgaacaagcagaagtgcttcaattctggtacgaatatcacgctgattccagaatttacatggttctaacttaaatgtgtcaagctcattctcagaaacaccattaagacgttgaatatcacgaatgagatcgactaaaattggaaaatcaaacgacattccacggcaccagccttgagatttccaaggatcgatattatgtgcattgatgtaatcattaaattttgcaataccgtcgatagtgcttacatcttcatcggatggtgcaatattttttcgagcttcaggagattgatttttccaccattcgatagtgcttttagtaaaaagacgatgtcctttttggctttttaaatcaaatttgattttaatgccacgtgaaactaattcatcaaacgtttcaactacttctgggttagggtcaaaagcaattacagccaaatcaataacagctgctttttcaccgcttcccattgtttcaaaatctataataaaatcaaacattaaattttcctcgctaaatcacgaatttgacctacagtatagtcttgaatataaactttattgataggctcatcaataaattttgccatagattcaatgtctttttgtatttcttcaagactgtatactatctttaaagctttttcgcgagtagtaatattttcaggaccctgattttcttcaatgacagctttaacatttgtcataagagatttaaattggtaccaacttaattcaatcattaataatcgcctcataaagatagctaatttcgcctaaaacataatcattaattgtaacagttttcacttcaccacaaaagaattctaacgcaattaaatctcgttcaatttcttctaattgaagcatcaacttactagattcaatttttacagtttcacgatttttaccatgagcaatttcataaatttcgctaactttatcctgaagaagataaaactgatctttagttatttccacgaatagcttcctcaaatttaattagtaatttacagacactttcatctagtgtaattaccgtatctgtattactgtgatatgattgtttttcaattcgtttaattgctaatatagtatcacttataagataaagcttatgaaggagctcagctcctgttaccataacattaagattatcttgcttattagtatgcttccttataccatctattagacgatttaaatattttgaattgatgttaatcatatatcctcacacataaaacacatcataacgaccacgagtgacacctacataaagaagttgctgagctaattcagcatctgcataatgaatacaaggcgtatagatgaaagcacggtctacagacataccctgtgctttatggaatgttgatgcaggaagtgctttcactttactaaactgtgatttagcatcccaaaaatcactccacggagcctttccgcctttattccaatttttataagtttctgctgttttacctaaaaataggttaaacttatacaattcttcatcagatgaaattattttaatcttttcacgataatattcatcatcgccgtaagtttctactgttaaatcccaatgacgaattaagtattctccaggaacaccacgagctttaacaaacgttgatgtatactctgcttctataatacgaactaattgtccattattaaaaataatttctgacacaggctttccatcaattttatatgttttaattaatggttcctgcattacaataatttcaccgacaataaaatctttatcagtttcaaaaatctttttacgaataatgctatttaacttgtcaacagatttattcgtaaatgccattacgcgattttcaaacaaatcatctaaagatttgacgattgaaaaataatttaccataaaatcgcgtaaagcggtatcaccagtaaatccacgtactccatgcccgtcaacaactttatcataaatccacttaccgttacgaacatcagtagctacatcaataataggagcattactgcgtttaacttcagtgagttcacactgataaaaatctttatgtgtaaagaatggactgatataagcagtgttttctcctgggtcaacaggtctaatttgcttattatcacctattccaattatagtacaccacggcgggatagttgaaagcagaattttaaatagctttctatcatacattgacacttcatcgcagattaatactctgcatttagctaaatctggtacttccttctgctcaaagaggacattttcttcatatgttaccgggttaattttgagaatactgtgaatagtactcgcttctttccctgatagttttgaaagaatctttttagctgcatgagtaggagctgctaaaataatgccagtttcgcccgtagatattaaggcttcaatgatgaacttagtaagagtagtcttaccagtaccagcaggtccattaatagttacatgatgtttcttttctttaatagccctcataacaatgttaaaggcatttttctggccttcagtcaaatcatcaaatgtcatcgtaaattccctgcaattggtatactaacaatacgcccagtatctaaaattcgccgatataatctttgtgtgtctacatcaggcttaacatgtttaacttctattttattaaaccaaaacttgcgtggagtctcaactaatcttggaattcctttacctaaagctaatcgatactgctctttaagagtagtaaatactttatcagcaatattccattcaaaaaatacagcaggacgatgttcatcaagcggaactggcgccgtaaatccgtctttgtctcggtaaactatcgcatatacataaaccatattatcctcggataagtttaaaaattgaacaattcagcggatatcctcttttcagtttaagtttatcaataaaagacaagttttgataccgctctacaccttgaataattttatcacacatatcatattgcatttctgcttctgacaactttttcacagttttccaatccgagcctttaagaagaacgttcagtttaacaacttcagcgccttctgctatgcgagaaccatcaatacgagctttaagtgctataatccttagcttaatgtcagaggtctgttttgatttagaaagctgagaaatgtgctcaattcggttttcacgttttttctgtatagctttaatttgattataagtctttttgattttagcccatttcttttcatctaaatttagtttatgaacttttttcgcagatgaacgaccaattcgcaaagcaaataaatcccgtttttcaatcaactcttctaaagtataatcagaacgaaatgtattatactttttctttactgcaataacattccctttaatgtatccaatgttattatcaaaacgttctaatgataatttctctccttcaatacgattatcaaaaggttctcccgagtaagcgcaaactttctgatctaaaatgttcttaatgtaattgaagtctaagttaaaatctttagaacgtctttttgcagatgcctgagtatgctctaaacgacgtttaattttacgaatttgattattagacagtttcatatttttctcacatcttacggacgattgactactatactataacatttttactttaacttgtaaacaactttatgtaaaaatgctttaaaaatttcatggtataatgaatctaagtccttccattatagattaaatccttcaaaatcaagagtatagatagtgtatgttgaatactttttgtactcatatctatctgcaattttaaatacacttccagctggtatcattacttcttgttcatctgaaactaattccatattgcgataacgatggctatctggaaacttaaaacttggactatattctttacagcgtagagcttttatagcatactcctggaaattaaacaccataggagctttgaattcaaaaataacttgtgtgttgtattctaatccagaagcaaaatgtagagctatatttttatcatatgaagctgatactactttatcaaatgtaataatatcaattccttgatttaacacctgcttagtctcaactggaacacctctccaaagaggtttatcgtttggaaccaaacgagatttgattatttcatttaaccaagaatgatcgtctggtttattagtaatacaatgaattaaaagttcaatttcggataaattaaatccttcagaaagtaattcttcacgaatagaagcacgcaccgatgcatccattgatttgattttaaaatcttttaattgcattgctgaatatttcattcaactacctcaatatcatacactttaaatgttccaaacgaatcgtgtaatttttcttttgaaatagaagttattttatactttccaattggaatcatccattcttgttcacgtacaatcatcattaagttatcagtacgttctgaatctaatccatcagtatcttcatatgtatacttaaactcagtattaggagaagaaagtataatatcgctgatatggtcagaataattaaaagctttatcagtttttaagcgaaatattatttcagtggaatattcaacataagaaaaaccgcatgctgtatgcaaactagtagtaaatgaatctaccctgttcgttgaaaacacttctccaacttgtaaatctttaataagttcttttgtcgattttgatataccacgatatagctgataaggtgatttagttaaatgatttttaacgattttattcaactgccgatgaagagcttcattctttttggcttccatacattgccaaagaactgactgttcaaagtccgtaaatttttcacagacctttttatacatatcatattgaaaatcgacgctttcagcttttatagataactgttcaacatctgcaagattaataatcatgatagcctccatatacttcagaagctatcatatcattgttaggaaggaaagtaaacaactttttgaattattttgcccagggagcccaaggcggagggtcaagatggtatgaagctagttcttctagaagagcatctggggcttcaattccataattctgtaatactatacggtactctttcttataatcactagaatcattctggatattcgtagaatgattatcttctaacatctcaaataaatccatattaattcctagcgataaaaaccaaattgacgattagcttcaataatctttctttcttcttcggacattctccagcgtagtccaacatcaaaatgagcccagaccatcttaacaaatgcatttatatctttaatatcttcaataatgaatgttttacttttagaaggttgactaactaatttaactttatcgtcttcaaacaggtcaaaaagaccatattcatgagctcttttatagcctttaatagttaaagcttcagaagaagaaaatggtgaatcagtattctgcaaaatatcttcagtatgctttataattagaataacattttctggatattttctttcttttatatctttaattaaaatatccggattttctgctaaaggaataattaacgagcattttttatcaagtgtatttactgatttaccttctttggacataaattctattgaataatgttttgctacttcaatcatgtgatttcctcttgcctactaatgggccgtcaggaattttgttttcctggatatatttctcattttcttccatcattttactgccaattttaagaagcaaatctaaggcttcatttgcttttgctttagcctcttccagcgtcatatctttgttcatgatttatcaccatagatgtctctcatcaatttaagcgctgagcgttctaatttcttttctttctcagcactaatcattgatttcatccattcttccgattcgttctgcatttctttatttgcttgttcaacccaaccatcatcaatgtacattgagtttggtctactaaaccattcaagtattttcttcagaactttcatttgttttacctaaaacgacagtaggagcatcgtcaaatttatgaatttttagcaaatttggatttaaattattccataaagaggtaataaaatatgatagcgcactttcgtctgtaattataaatttatttcctttatctattttccaatcatgtattgaatcatatgaatagaaggataatggtttattattataatatgcttcagcaacatcaatatagttagatttagtaaatgcttgaattgccataaatggagaattttgtacagtttcaataattccgatctttttaagttttatttcaacatcttctggaactggcattgaaataaaatcttctactagatacatgttattgtcatatcttttatcaatcattactgctacggtaattggaacatccttgacaaacgccatactaatactattgatagacatttcaaacaaaattgcttccataattttcctcaatcacaagatgtagatgaacaactagaatcacaagaacttccacatgaatcacctgcccatacgtgaacaggaacatttgtatcatatgaatcagaactagactgtgtattctgtgtgttagatgatgtagtaggtgttgaccagcgccaaggatttttataatattcttgggcttcttcataagtcatagtaactgcttctactgttccatctcccatataaacatattcaactacagttaaaggaaggtagtcatttgaaataggaactacaccttccccaggagtcgtagagaaaaaatccgtaaagaaacttttaaaccaattaaagataaacattacaaaaagcctcttttgaattcgacttgcttctcaccataatcataccgaatctctgcattaaattcgacagaaccatctgcgtacatcataaatgaatgcacaacaacttctgtagaccatggctgtagttcatatttcttcattacatgccgtgaaatgataatatctaaatcttcatttggtttaatccaacgatttaacatagtgctctcctctataagataattctattataccatactcattttggaaagtaaaccggtaaaatgaaaaaaggactccctagggagtccttgaattattaaccacctatttctgtaggtgtaaacattgcagcattcttagttttccaagttgctgcatcggaaactacatcagaataagctgctttttctgacggaaagatttgataatgagaatctgcaatacggtgttcatttgaatatacatcaaatgctacagaaacttccatacctttaacttctttgccttcacctgctggatgagtaaaggtcttgatgttaacgaaaccacccataataaactcctttattgtttaattacaggtgtatttatatcagtcttcaatgaaaacttgtgccaggaattcgtgttcatcttgaatttgtttatataaagccattacagcatttatattagagctatctactttaagctgataagcataccactcgtataaattaattaaagctttttgacgtctaataaattcttctttggatattttcattttgaatgttctataattaattttaaggcttcttcgctgacaaaaatttcatcaggaccttcttctacaacccaatcaaccacacgaagctgattagataagagctcacatacgagctccttatcataatttttaaatagctggtcaatacgtttcttgcgggctttcttaagctggcgtttatttaaacgagccatcaataacctcggtcttgacgagcgaagttttcagcatttttcagataataaagtttaaagatttcttcagccgtaagaccaagaccttggaacatgttcagaacgaaatgaagaatatcaatcatttcgaatttaatttccaactgatcttgcggagacaaatcagtaattagagtttcacggcgttcaccatgttgagctttccaaggcttccatacagcagatgcatctttttcaccattgctcatgccgccaagagaagtcagaagttcacggaattcatcgtcaatataatctttttgattacgcagccaatcaacaacttcgcctgcagtagccaaatcatcaggatgacggttatattcaggtttatctttagctaaacgaacctgcaaagatttctgcatatcaagcataacctgtagtgggtctttttcatcaccgagaatatcccagtattcattttgagctttatcagcgccttcgatcagttgtgaacattcattaaagtatgccattatttttcctttcaattcatgggttagtagattaattatacaataaatatataaagcaataaggaggacatatggtacaaaaattaatggcacttgttaatgccataaaaggtaataaaaaacgtatagcttttactatttctgctatggtaggaattttactctggaattttgttttatcaccaattgctattgctcatggtgttaatattccagtaattactcttgatacattcgtagatttagcatttgctttagttgggttaatttaaatcttagcatatttagatagccgcattttagccatcaacccctgcgcaatattatttttcatatattccataatttgttcaggggttgcaccttcctttctaatcatatcattaacatcttttgatttccagggagatttgtcccaaaacataaccctttctcctgcatcaactaatttagtcattcgcttaatagtgtcagggtgacgaggttcattatctaaaacccacacgcgtctatctttaaatggaacaacttctaggtctaattgaccacccgtaatagctataccattttcaataaaaagtgaatctataggtccttctagaacatatacatcaccatctttaacccgttcgactccatagatttttgttgcttcaggataagctttgatggtgatatatttttgaggagcatctttctttaatgcacgtccttgaaacgactcagcttttccattagcattataaattggaataacaagacgaggctcaggtatttcctttttatatgttcccggcgctatgctattaactaatttaggccattcagttgtaaaccaaagatatttccatttatcctttggaatacagcgagcttttatgtattttataattggatggtcttccgtcagtttatctaatctaacacatgacggaagagatttaattattttcttctcgggttgtttaggaagttctttaggtttttctactggacgacttttacctttttcttttcttatttcaaagatatactcacgatataaatcaggttcaaactcctttaaatatattccgattggtgcatgatagttacagttataacaatgaatatttccttcattattatcaccataataccatccacgggctttattttggtcggtttttgaatctccacaaacagggcatctaaaccgtaatttaaaagttgaactattatttacttgtgcgaatttaggtaaatgagccaatgcacggtatgcaaactcattatcaatccaaggtattgatgacatttttactcttctttttctttagattcctcttttttctttttaggaatctgttcaggacctttatttactacagcacctgacgttgttccagtagagatattttcaggattaccacctgaatctccagctaccatatcttctttaataaattctttatatgttttcatattaacctctattcataaaagcattaaaaatttggtcatcaatagatggaatagcaaccttttcggcatcatttagcaaatcattaatttcatcagatagcataacacatgtgcctttatttcctgtaattgttactgcacaattacgaacgttttctttatcaaattttaggttaatattttcgtagtgaaaatcctttaatgctgaatatatctttaaaatgaaattgtcttttactacaataaacccaacctcactattaaaacgtggttcatggaaactgtaataaaccttttcatctataaaatcgtatgaaattttttccatttttaaatatgaaaattcagaactatacatattaacctttattcataaaagcattaaaaatttggtcatcaatagaaacatttactttagactgtttttctgatggtaattcatatccacatatcacaattttgtgatcaatatcaaaatacacagaagcaatatgattaatgatgttttcagtaaagtctaaatcaacatcaatatctttttgaccacagcccaaaggataaataatgcgagtaattcgattatctttaacaaatattccaccgacatactctgtactgcgtttaaagtctacacgccgacgaaatgaaaaatattcaggctctttatgagctcggctcataggacacaacgagtaactagaataagagatgtcaaatcctacgccttcgatatgagccaaagtgtcatgattaaaccaattataatcgtacgccaaatccattagattataatatgtaaaaggcaccggattaacatcattagtcacaagcatgtaattagcaactgctataatttcattgtttttaacgaatacaaaccgtgattgatgcgaatgacctggacccgcgttttcacgattaatgatataacactgggcacctttatatttgtatgtatctttgcacttgtgcatttgataaagcattattcacctaccacttcagcgatgatatttttgttattaaagtttttatcgcaatacagaacataattatactgcattacaccaccagacttaagctgtttttgcacttcagctttcatttcaggacgatcgcgctcaacaatattcataatatccgcttcaatttgagtttcaacctcagtctgatcagcagtcatagaccattcgcacaaatctttatcataacctgccatagcaggctgagcagcacaagaagctaaagcaaaaattgtagcaaagataaattttttcatgataatctcctcagtagtttatgtttatatagtatctcaatttccaacaaaagtaaacagttattttaaaacttctgcgtaatcacatgttacaaaatgtttctctagcttaacgattttacgaaaataccttttatactgacgaatctgcctcttcgtaggacgtacagcaaacttaataaattccactcgaccaaatggaggactttcttctgctggaatatctaacaccaattcccacgtatctgcaataagtgctttgaattgagtatttttcctgacgttatacggagtaggtttaaataaaacaatatgcatattatcctcggcaatccacttcgcacactttcttgtcatcaatgaaagctttaactaatgctttattaacttcagcatattgagtagtagcccattgaacgtcatctttcatcattgtgatttctttagtaaacatgctttcattcttaaaccaccccataaaaactacctttaccaattccataacaatctcctcatttaaccaacaagactactataccatagtcttgtcggcttgtaaactaaaattttaattcatttgccaaagcatctaactgggctcgagcagattcgtttctttgatagcgattctgttcagcctgaatctgctgtgaacctgctacttcactcacttcagttggagtagaatcttgttcaatttctacccatttctgatttcctttttgaacacccatcaaaaacttattccatttattcttatcaccatatcgtgatttgatttgcttaattagttgttgttcagcagctgctagctcctcggtttcaatgaccgcaagcataaaatcggctgttgctggaagcccggcagattctgcaatatcgctcatgttaacatcagaagagtcccaagcttgcttaccaacctgtgctgcagtccaaagaacggtttcggtttcaacagccagagcacgcaattcctctgcaatagctttaacagttgtgtaactattttctgaataaactctgatgcggcaagatttacaaatacctagatagtcaacaataatgattgttggaacaaaattctttttgagcttcaattcattcaagagagacctgaatgtattagcgtctgctccactagtaggatactgtttaacgattaaacgaccgagagtagatttctcacgccatttttccatttttcctttatactcggcgtaagaaatatgtccatcatcaatatcgtcaagagaaacatcgagcatattagcatcaatacgtttagcgcagacttcttctgccatttccatggagatataaagaacgttatgaccaagctgcaaataatctgctgccaatgaacacaatcctaatgacttaccaacgttaacaccagccattaaaacgttcagtgttccagtttcagctccgcctttagtaattttatttagaattttgagtctaaatggaaccttacgagctttattcatataagatagccaacgtgcttcgtagtcatccatccaatcatgaccaacgtaactatcaaatgaaattgataatgcttggcgcatgatgtcaggaatagcaccaacatccggcattttcttatttcgtttttccggaggaagctcagcattagtttgaatttcaattattttagatgtggcgttaaacatcgccctttgctgaacatatttttctgtttcttttattaaccaactatggtcttccggagaatcggctagttttgaaataagtgtttttacaccagaatattctgtttcagtaaatgaactattttctaatgcaacatttaacgcattaatagatggaacgctatggtactcattaacatgagatttaattaatttgaatgtatttttagctggaccactttcaaaatattctgaatccatatatggccaaacttttgaaaaataagcttgatcaaatatgagatgagaaagaataatttctaccacacttactccttaaaagaatttaaattttttctttgaccttttattaaatgcatcttgtagttgcattgtaatacatttttctacatgaggagctaactcagcttttctttcttggtcaagaacagcaaagtccattacgacttttccatcaacccaatctaattttgtcacatacacaatgtgtgtagaaccgtcttctagtttaatgacaatctcctggataacattttccatggcagatttaattatcttaagagattcattaaaaagacgttcttttctttcttcttccccctccgaagagggggattcgtcgataatttctagatctaaatccaaatcatctttattcattaaattcttccatatcacttaactgatctaggtcagtttctaaatcagctgctgatttacttttactttctggatatttaaatttttcaacctttgagttaatcaattcatcaacttcagcttcaacaatttcattactatcaatagcacctaactgataagcacgtttaatagcatctcggaatggttgatgcttaaataaaggaccccagaatgtagtacagttggtatcttttgcacgccaagatttttcttcgcgaatcatctcgccggtttcttcatcaagaaattcacgagcataccagccatttttaggttttactacaaatcctaattcaagagccatatctaacaatccagaataaggatcgataccgccgtcaaatttaacatcaataaagaatttacttttttctttaacggtacgagatttttctacatttagaacaaattgatacccctgaagatcagaaccatctttaatctggcgtttaccgataatgaatacagtatcagccgaatacattacgcctgtaccacctgtcatcacggttttactaaacatttcaattgtttcaattgtatggttaaccgcaacgcatggaatatttttaatgctaaaataaggagtaacaatacggaataatgacttcagtgatttagcacgagtcatatctgccacagatttttcattcaaggcatcttccgtttctttcttagaagccatattaccaattgagtcgatgaatacaataactttttcaccgcgctcaatagcttcaagctgattcaccatatcaattttcagttgttcaactgactggattggtgtatgaattactcgttccgggtcaactcccatggatcgcaaataagctggagtaataccaaattcgctatcatagaatagacaaaccgcgtcaggatatttgttcaaatacgccgcaaccatagtcaaagacatatttgatttaaagtgtttagaaggacctgcaaaaatggttaaaccagactgcataccaccatcaatcgcaccagaaatagcgatattaagcattgggatttttgtacggattacatccttttcattaaagaatttagatgtagtcagttcagcagtcattttagaagtggaagctttaatcaaacgggattttaaatctgcaatagacattcattttttccataggcatcattatattttcctcactggttaaagatagagtaattataacacaataaatttaggcattaatcaactgctattggatgaatagcattaaacttatgaaatgcttctgatttttctttacgcgaaacacacatgcgaagaacctttagtggttcatcttcttcacccaacgattttcgtttttcaatattcgatgttttccaacgagcttgctctggaaactctctattgatttgctcaagcgctctattatgtttagaattactacgaattgaactacacccgccaggagcttgtgcttttccagatacaactagatatttgaacaaggccaaatgcggataaccttgattaattaaattgagaaatgcatacatatcttcgcataaatcaatttttccatacccaatttgttctgtcgtaagttttccaaggtcataccaagtattcgtgaatccatatgaattttcacgataattaccccaagatgaagtaattttaaaaattggtaaacgagcatgaccatgataatacccacaatccatggcatcttcaacgtattgaatcaattcatagaactgttcacgagttaattgattaattttatctacacagcgacgatcatctttctttcgcattgaactcatacgaatagtagtatcatcatcaatcatccagattcgttgacctgcatacatatcagtaattgctttacgagtaccagcaattccattaacatcatcaggaatagttataattttggctttagacccgtaagcgtcataataagctttttcttcgtgttcacgtactacaatatgaggttcataatcagtcggaaacatatcaagggcagaaactgcccctacgcgttgatagcttggaattacgaattgaatcatttccactcaccattataatcttttttcacaatatgagtttcgccagtattccaccaatgatcaaccaagtaaaaatgacgagaatatacatgaagacttccaacattccatataatagaacctgctttatactgacgagttgaatcacctgcattcaaatcagatactaatttatctagtacgtatttttgccatgcataatcattacggaatccgaagacaacgtcatttgaacgcatgctcactactgcattgactttcttatcacgaatcaggtactgtactgtattcgtacacatgaaatctgacataccatctttattgtagtcaaactgcatggatggacgagtataaatcatgataccgcgtcgagaatcaggattttgaccaagttcagctaaacacatatcatactgggcatagttatcttctgaccagatggcccaaccataattcgagttaatttcgcctttagaagatgctacctgttgccaaatcttcggtgtttcacctggaatatctttaacaaacaaacttttagatttataccattcaagttcacgctgaatgtattcatcattaagagcgccaaaaataaatggttcatctgctacaaatgatgcgccaataatttcaatagttttaacgccagttttatcaactacgaaatctttttcctttaatgcaagccccaaatgaagacggatttcttcaactgtcatataatcgttaatcatttaaacctcaattgatgcattcatatttaatttgtaacagtaataaactccaacctataataagtggcggaatcataagaggaactgttacgctatagtatatacttattataatcatcaagattaaaagcaatactgctaaaattttgcttttcattccttctctctgatgataattacttgattttgctgtacagattttttagtttcacccgcaattgaccaaataaaagtaataaaccaaccaatgattgaccagttaaacagtaaagatgtgaaaaagattcctactgtcgattttgacccacgcatcaaggcgatgaaccacggaagcatgtatataataatagccaacacgcctgaaactaaaaccataaaaattgaacctgctactaaagtttccatgttttcctcacttagtcaaattttttacacatgaattataagaattcactacatactccatcggagcatttttacctgtacgccattggtaattattagcccaattggcccaaagctcagcgcagtagttttcaattttttcttcgcgtgtaattacatctgaattacgatatgcttgagcagattcatctgggcgaatagcttcgtcaaaattcgcctgcatctgttctactgtctgttttggagcttctttataacacttgacattaggattataaaatttgcttgaacagtttacaatttttcctacatcagactgatttactaccggtccttgagctacacaaccagtaagacctaatgcaataaccaaaatagcgattttcataataatttcctcaaatgcaagtagtaattactccagtagtgcttatgcaggtattacccatttgcacacctaaagatccatttgtattcacatgaagattatcatcaattttaactgatattttaccattagtgtgaataacggtgctagattcaatcacaggttgagtatcattttcaacactaacaaatggaactgctgctaatgcaactaaacaaactgctaagcatcccataacaattttcattttattctccaaatccgtattagttgatagttgtatagtaccatggaagaacagtcttgtaaacagttttgtgaaaattttttagggaattctaaaggtccagaatcatctgtttttcataagtatagatttatattacttgtatgaaaaagggacccggaggtccctagatttattctatcagccaaacaggaagtctaacgaagctttttcttcatagtccataccagccgattcacacatgcctgcaagcggtttaacaaacgatttttggaacaaagttgagtagtcaatccaagacagtacgtcagaacgaatttcttttggaagttctgtacccgacggccaagcaatgcatttgtcaccaaatggatttccttcacgcaatggaagaaccattactttatttccatccaaaattggagctacacctaaaccgctaacagctcgacgataagttagcacaccacgaatatggaacggacatttaaatcctggccaacctttatcatcatatttcgctatatcgttcgcagtttttacttcagcaataactttatagtcaagttgacgatattctttctcgaagttcttgtaatattcttggacagactcttcaccttcctgaagaatacgacgaatactttcttcgagagcttcttggaccgctttaggcgttgaactctgctgagtttccatacccatgatttttagatgcggttcagcaaatcgcttatcttccatatcatatacgttcagagcataacgctttttcgctttccaaaatccgccaacgccctttgaaccaagtggagggcaagaaatagcttcacggtccatatgcatcagatgctcgcggttattcatataatcacataactcacgatatgcaacatcaatcataggttccatctttttcttaccgaattgattcatgaattcaactaaatcgttctgctctttgaatcggtcaagaccaactttttcaataactttatctacacaaacatataccgaatcagtatcacctgctgcaatgaaatcttcgccattagttccgcatactttattcagatattcattaattttacgagcaatccactgaataccaacttggccgaaaattgtgatagcagtagcatttcgcaaatcatagtaacggaaatgaatattaccaagagcaccataaagactgttgataagaattttacggtttagctgatttgtgttagcaagtgtagctgctttttcacattcttcgatcagactattaagaacagattcagtgtaattcgataattcatttaagaaatcatcattgaacttaacatatcgttcaacttctggtttagttgaacaagaccctgcgcctttcataataatctttttaatagcttcggcattcatttcttcagcgaacattttctttttccaatctttacgttggaaaaatactttagcgatttcctttggaatgataccttcttgatgcttatcatacatccatccattcggagaacaagaatattcatcgctcggtttaggagctgttcctgcgatatattcatgaattggatgaactttaaactgtccacgaatagtctcaggactaatgttaacctgacgaataatgctcggatacagagacgtcaagtcaaaactcataatatatcgacgagcaattggtttaggttcaaacacaaatgcacccggaaaactctgtttaacatgcgaaccttgctgaggaataaccttatgttcacctttcaatgagttaaaaataatagcatcccaagttttaataggactcattacaccggaaaaaggcattttagcgtaataagacatacttaaaactagatcgataaacccgcgaattttatcaattgcttgaactgattctacgtcaatgatgttataactaatgtatcgttgatgattagtctcacgaagtttattaataggaccgtcgtatggtaatttaccttttttggtttcatgttgagcaactgattccaaagagaatgacggcaaattagtaaaagcgaatttcttgtacaaatctaaataatcaagaatagatacgccatcaatagaataaatttctttgctaccgtacatattttgaattaatttagattttactcgaccgattggagagaagcgtttcatactacgttcaccgagaaccattttaacgcgattcatgatatacggaacgtcaaatccctcaatattccaaccggtaaaaatagcaggtcgtttctgttcccaaagattgatatattccatgagcatatcacgctcattatcgaatggcatataaattactcggtcaagaatttcttgaggaacttcatcaccaccttcacagtcaagcttagcagctaactttgcatcccattttgatactgaaccgtacattgaattcaaaaggtcgaaaacataaaaacgatcatcaattgaatcgtaatgagtgatagcatcaatttcatattctgctttcattgggtcaggaaatttatcgccagtaacctcaatgtcacagttagctacacgaacaaattttcggtcataaacaatttctgaaccgtatgtatcactgatataagcgagtttaaaatcgttcataccgagagcttcgagaccgatgtcttccattcgcttcatccaatctcgagcatctttcattgatggaaatttttgaggagcgcagtttttaccatagatgtctttgtattttgactcttccttacaatgcctaaacatagtcggaagatattctacttcacgggtacgttcctttccgttttcatcaatataacgttcaacaatgttatttccgactgtttcaatagagatataaaattctttcatagatattccttagtttatagcccgagttattaggctcttgatatattatactccaaataaggggccgaagccccttgcttaaattaataccagttgtcggtgaaaaattgttaatccatctgcattaattgacttaaccactgcggtaaagtgtttttgttctgggtgaactaatttttgaaattctacctgaaattttagttggaggttttctggtaaatcaaaaagtgtttctgttgcagaaagattatatttttctttaagagacgccatgtattcttgcggagttatagcagtcatattaattaccaatcgtatatttaggaacgagtttccattcatgtttttgtttaaaagaaataactcggaagttattggttaaatctttcataaaagttctttgaccaggaacgatttcaatcagtccccaatcttctaacagccacgcaatcgaatcacgacgaacttcatcttcttctgtcatttcaacctgacggccatccatacgaagcatttctttaaaatgaacgatatagtatagtccttttttctgaagaatgtggcaggactgatacagaactttatctttattattagcaattcccatacgagtcaaagtttcttttactttcagaaaatcttcaggttttttaagagtaatttcaatcattttaccattccaatgctagttttttgagttgtttctgttcttttacattcttagtcacttcttttaaaaaatcatccgtgactaaaccttttagttcttttaatactaaaggaagttttccatttttagtaagaattgatttatagttaattgcatcatttgtattaacttgataccgcttagcaagtaacttaataatcaatacttcagtagaatcttcgaccagttttgcccatttaccatatcttttaccccgaggaacagcagccatcaggtaattaaaatgggcttcatcgcttaaacctgatccaattaaattcatagcatatacagctggcatgcattcaggaaattgtgataatgcattctcaaccatgtattttgaataatctttttgagcaatagagcatttagttttattattaatagctccaattatttcaaaaaactcattttcagctttttctttaaaagaatcagcagcagattggacagctgtccaatcttttgaataccaagcaacttgatgctcgtttaattgaatatcatcttcaaataagctcatatcacttccactgcatttcgcatgccaattgaatgaaaagatatgctaaatgtaattccgtattagccgcaattccgtgatactggttattttcaccaacaatttcatacatacgaataatactttgtggagttacgcgtgtatagatttcttcggcaagtttaccaacgaaccacgaataatcagccgcatattttggtgctaaagctctgagttgtttaacatctttatttttgagagactcaagaacatcatcaatagcaccacgatcgttagtaaccagtgataaaataccagcatccaaaacacctttagatgaataactatcgagctcgccaatagttttacgaaaatcaggaaaattctttttaaccaaagctgctacaactttcatatcagctatagcaataccttcatgtttacagatttcagtcaatcgacgaatcatctgcttcatcatttcaattttatcttcatcggtcggttgaccgaacgtaataactcggcagcgtgactgaagtggtttaataataccatcaatattgttagcagtaataataatactacagtttgaactataagcttccataaaggaacgaagatgtcgctgagattctgctaaacctgagcggtcaaattcatcaataacgattactttttgacgaccatcaaatgaagctgcactcgcaaaattagttaaaggaccacgaacgaaatcaattttacagtctgatccatttacaaacatcatatcagcatttacatcatgacacaatgcttttgctacagttgttttacctgttcctggagaaggagaatgaagaataatatgtggaatcttacctttacttgtaatagatttaaaggtttctttatcaaaggcgggaagaatacattcatcgatagtagatggacgatatttctgttcaagaatgtgttctttttcatttacggtaatcataatttcctcattcaagttttagtgtaaattataaagggccgaagccctctattaaaaatcgtgggtagaatcagcttcaagagctactacataattcgcatgttcaccttcaaatttagcagcaccttgtttaccttttgcccagagcagaagtttataatttcctggttgcattttcatatttgccatattgataatgaaattaaatgtattttcaccatcataatcaccaagagtcaaagaatatttaacacgggtcagagcagaatcttctactttattaaaaccgttaattacgattttaccttcttttaccgtgatagcaattgtatcaatttgcagaccacgagatacacgcaacagttgttgaaggtcttcagctttaatttcagtaacaacagatgctaccggaaatggaattggtttattaggagcaactactgtactcggatcggctgctggccaaaaaattgttgaacgagcatcagcaattttaatatttccatcttctgactgggaaatttctgcatcatcattaactagcgacagaataccgagaaaaccgttcaaatcgtaaattgctacatcaaaatcaataacgtcagaaatatttgcttccgcataagttgtaccattaactgcacgagtcataataaattgaccagatttaagcataataccggagttaatagtagcgaaatttttaagcagagcagtagtatctttagacagtttcatgtaatttccttcaattcaaatgagatttaattttataactaatttaataaagcaattaacgattaaaatcagccgcaattgtttcagcaacaatttgagcagcaacaattaggcgttcatctgcattaccgcaatattcatcttcaaggcgttcaccacatgaagtcataataaatttagcaccggcgtttagggattctgcagtatgtttgcgcattagttcaatccatttattacttacttcacgatcgatagcttcataatacgcatgacgagcaggtgcagatttaattttgttctgaataacttccattgcgttatcagaaagagacaaaacccatgcgcgacgaattttattttggttttgtggatttgattcagaacgcacgtgttttggctgaatatcttttacatcaacagtataattcacagtaattttagtcataatacacctttagtcataataatcagtaacagtccaagcttcatttctattggacattatttttgtatattctgctttaaatgcattcctaagcatagattcagtaactatatgctcttcattagaaaaattatttctcagaatatatcgttttatttcaggaaaagttaataaatgctgtccagttgaatattccatgtttttcctccatagagattatactctaataaattaaagcataatctcttataaattaaaccattacagtaaatcgaccaactttcttcatttgaagatgctgaccatattcttgcgggtcatggtctttatgcgaaattataaaaacattagtgtttttcattgaatttataatattagctacacctttaataccttcggcgtcaaatgacccatcaaacacttcatcgagtattaatgtactaatactaacaccagatacaatagaagcaatatcacgccaagtaaataaaagagcaatatcaattcttgccttttcaccttcactaaatgaagcataactaaaatcttcacgaccacgggatttaattgtctcattaaattcttcatctaatgtaaacacataatccgcttccattattttaagataatggttaatctgcttattaaataatggaatgtactttttaataatagcacctttaataccagaatctttgagcatatcagtcaaaattcctcggtggtatttttccattactaaattagtttttgtcttaacaattttatcaagttcttcttgaagcagtgctatttcatcagcatggtcaataaactcagaagatgctttttctatagctgctttaacttttttagctttatcgactgtagtaattaaagtttgctttttattgcgaatatcatttgccaatgactgctgagtcttgatattatctcgatattcatcaacaagaacttttaaattatcacggtgtgctgaaagctgttcaaacgaatgtgtgcattcagaaactttatctttaattttagaaacaactttatcaccggaacttaattgtgacaaacaggttggacataatccaccttcgtgatacatattaatgactttattatatgagtcaatttttgatttaattaaaaatgcttcttgacctattttattgaatgcatcagtcgggtcttcatccaaaacaatattaactaatctttcattggcttcttctatttcggactttaatgaacgtgcttctttagccaaatcatcatacatattctgcagacgagtaaggttatcaccggttaattttttctggcgttcaacgttatcattatatattttaatttgttggataatactatcttttttaacgtcaagcacttggttttgtgaatttaattcacgtattagtgctttattaagcttatccatttcagctaatgttcctacctcgagcaggtcttccacaagctttcttcgcgcaggggtcgacaaacccatgaaaggggtataccctgctgtaccaaggacaacaatctgcttgaaactggcatatgacattccgataagctgttcaaattctgcttggaaatctttactgctggcagattcattaagacgtgtaccgttaacggtgatttcgaaaacgtttggtttttgtcctcttttgatatagtactttttctcatcatattccatccacagttcaactaaaagttctttcttatttgtgctgtttattaattgacctttctttacatcacgaaatggcttgccaaaaagcccaaatgtgatggcttctaacatagtagacttaccaccgccatttcgtccagtaataagagttttttgaaccttatctagttgaatgtcaataggatttccacctactgacattatattttgatacctaactcggtttagtttaaaattcttcacaaaagattccttttaatgtatcttttagaccattctatcatatcatcataatctaaaaagtattcatcaaattcagccatgcaaacaacaccttgtgctgcttttgatgtgatataaattattccaacatatctagaatcttcttcggtgtaatcaatatttgctatgaattcatcgttaatgtcaaatgtcgaaaacttcacagtatgcatccttaatacaagatacagccatatcttgtaatgatttaggtgtgtcattatctaaaatgttgaagttaaaagatacagcccagtcagtgcagaccgtgacctttttaatacaattatcttcaacctctagcggttcaaaccaatattcaataatttctttatgcccaatatcatcttttacttcgcattcaaaatgctgactcatcataacatttttaaattcatcaaaagtcattgtgttgcctctacatatagctgattcgcatattgaataagtgcttcacggtcagaatcagtgatgtctggaattgcattaatgtattcttccatcaacgtctgaagagattgaacttcaacttcttcactttcatctgactcgacagagttatcaatttttgacacaactcgtaatgaatgcacaactttttctagttcagattcgaacttcgtcagatttttgtctacctcagttactataacacgtactgatagatttgtaaaatctttatagtcaatttttcctttaaatggataatgaattctacgatgccaggtagtattgtttggaataaattccattcgttctgtttctgtatcaaacatccagaacccacgagggtcattctcgtcacctgcagttagtgtccatggtgtcccaatatatctgacgttagcagcctcagagatagtatggaagtgaccagaccacacctctttataagtcttaaggaaatcaggttcaagaccgtgagatttcattcctttataaaaataaaatccattcagttcccagtgaccaacacaaaaagaagcagatgaagttttgatgtgctcaagaatttcaccagtattttcttcgcacatccaaggaattaaatcaattaaacatccgtcaaaatcgactgtagtaggcttatcatatactttaacattaggatatttagccaaaagctcagtagaggcatttggagttaaagtatttttaaagtgcatatcatggtttcctacaacagtatgtagggtaataccagcatcatcaagcatttgaactatttcacgagcaaactccatagttttatgtgtgattgcttttcgcacatcaaaaatatcgccgtattgaatccaggtagtaattccatttttcttagaatattctattgcttgtttaattccatccaactgaatggattgaacccactcatcatcggctttaacgcctaaatgccaatcacctaaatttaaaattttcatatatcaagaaccgtcattgaaatgcaaaataaaattattgaaataaacccatctggtgtgctaaagaacccaatccagcacgctctagtgaatagataaaatgcaagaaaaagtatcacatatccaagaaatatcattatatcaaactccatataaagctaaagggccgaagccctttattttgtaataatgtcaaactgttctttaaagcagaagcttgaatcttgatgttgatacaaaaattcatacgctttttctcgctcacggtcataaagagctcggtcagatgacagttctttaatacgctcgaatgttgattccatatcattttcatcaaaccaaatgataccgctatcatgcgaggtcaaaggagtattatcaacacggaattttaaattttcgccagtagatttccaaaataccggaattgttccacatgcaccaagctcgagatgagtatattctaaagaacgttgtagatattttttatccaacttactcaactgataaccaaatccggatttactcatacgttcaagcatttcgctatttacataacgatcgagaatttgcgttggtaaattaggagcaattttaatttggtctacttgatgaagacgataatactcgtatggaattcctttttctttaataggaatgaacgctggagaacgttccagaccttccataatagtacttagtcctgcaggtttaagatgtttttcatgaaaatcaaacatctgataaaagcctttccatgtagtcgtacgaccaatccaacggttgacattcatattaatttcagaaacatctttccagtatgttgatcgaaccttcgcaatatccataggaggctgaaagttgtatatagtcggtgcttcttcaatatcatcaaacagagaaactgtttctggataccattctttcatcaaaactttattaaaatcgccattatcagaatgactaaaaataacatcagctcgacgaacagtttcttctaatcccaaatttcggcgcaaagaaagagaagaatggtcatgttgataaactacaacacgaaccgaaggtttaatgttatcaataatttttttatagttattaatagtgtcttcttctactgaagtagcaggaactgaattgataattagaatatcacaatcatttaccagcttaagtgttttatcgtattcttttgccaataaaaccggaattgaaaatgatttataatcatgcgcgcaattacgagtaaatgatttatctttagcataaaccaaagttacttcatgaccatttttaataaaccaatcacgctgctcgagagaaaatttagttacgccgcaaccttcaagacctcgagccataaaaatacatactttcatttaatatcctcattgttttggtttattttaccaaaaatttataaagcaatataggagccgaagctcctatccgcataatacaccatacagaggctcattagagcttctaaattttatacgcttatatgttatagttccttctgctttagctttatcatgagactctttaaagagtctcatcatttctactttagaggaacgaattttattataatctatttcagaagtctggatgttcatctttcacagttgccaccattttttaacttgataagaatcaacccacactttcatattagggtctgctcttacaataggaggattaacttctttaattgaactatcatggtattctttttcagaaattttcacacaaagatgaccattcaaagattcagtaaatcctgcattaattttaagacgcttgaattttacgtgtgtaagcatcaatcatatcctcaatctgcgatctagtagtcttccaaagaatactaatgagttcatcgttatatggctgttttagaatatcccgacttttcttgatagcatattcgtattgagcaaaattattgttttcagctgcaatctgagcgtgcttataaagacggttcaattcgcgtttgtttttagacaataacttatttgcttttctttctgcttcaagacggttcttttcttcaatagaagaaataagcttttccacttcatcattaatttcgggtttatcagtcatattatttctctaatataaaataaaaatcatcatctgttaaatgataccgatagtttaattctacaccattagatttaaaagcggtatcatacggattttctggatcaatatcaatgtcaagagctaaaacttccctgagatacattttaagtaaatagggaatagcttcaacttcaggtatttcttccaagaatccggagaggttaatcgttagcctcatataaaaaatccaaactaggagaatcgtctacaacacttttcttttcagcccccggtgttctataggttgattcttcgtaatgcgtcattttatcatagatgtcttgaataaaagtttcatctactaacgcaaccatatcgtcgtcacggctgtcatagacattgtgaacgaagtaactatatttctttgcaacttccttacgttcttttttaatacgctggacgaatgcattaaaacaagcttgagttatatatgcatgtgggtttttatatttcgtttcatcaaaattgtgaagccccttaatagaagcttctataccatctgcaatcatttcttgtttccaagactgggtgtatcctgaaaagttgaaacgtttagataagccttctgcaataagcataatggctaatccgatagtatcattctgacgaactactttatttgggtctttattatttgctaattctgttttccaatcaataatagcttgtaaaagctctttattgtttacgtaattatatttaggcttagtttctgacattttcacctcttagctcaattcatagatctattatatcataatatttgaagatctatcttaaagcatagaggatatcagttatctaagtaaacagtatgcttgaaacactttctccatcatctttttaaattcatgaatatctatataatgactagttagatcagcatgatataaaaagtctaaaaacttttcatgtgtactaacatattcactttcatttaattcagaaacatggctttcccaatatccaacaccagtcttatttgggaaaaatgaaattttcatgtattggtcaacatagaaaatgccataattttcaatagtaatagaaatattaataaatttcatacattcatcaacttagccgcttcaagagctgcatctagtgaatcaaattggtcaacgtattcaatcaattcgccgtaattggcatataaccaccattggctaaattcatactcaaggatgaatccatttccctcaatttgagttaaaccaatgccatttgtatttacttcatatccggcaagacgtaaatcgttaataagagcttcgttcatattcataccttagcaattttcaggtcagcaaattttttcttgcgttggtttttcatacgacgaatagttttatcggaaatttcatgcttttgataagctttagattctacaccaaaagctttaacatcaaattctgacaagatatattgaaccaacaattcacggacagtattgcgcccaattttctgatcattctgtttcatcgtctgatgaagctctttttcccatttatccaaaatttgaggagttacaatattgcctttttctagcaaagagactactttatcatatgcataagaattgatggcgtttttaatttgaatagtcatacattatcctcaattgcgttaaaattttattatccaaaaagggccgaagcccttagctaaactgtttggcacccttccagccttcatacatcattgcggctgatattaatattgctcctgagcaacttgaatatttgtgattccaaaaccagtttagaaaaacttcatcatcaataccttgggctatcatattttcaaagaactgacgacgagattcggcaattcgttgtgataatttagattcaggattcatttaaattttccagttaccgttttcatcaataaatttaatccagtcatttactgaccacttagttgtatcaccttttggagtaacatttaaagtgtataacccctgcttaaaaagcattcgtttgatattcataatttcctcagctgtaacgataacactcgtttgatttacgtttagcaactcgttgagaagtattataatcaaaatcatcgtcaatgtaaactgattttttcaactttcttacttcaccacgtaattggcgatttagctcatctttaacttctgaatcaatacctttcattctacgccatttatctgagcgaaaaatgttttcaaccatatctttatgacttaccccatcaggagctttacgctttccgaaatagtcataatcacgtacttttaaatctttacgacgatacgttttacccatggagtttaatttccttagcaactgaactaaatgcagcacgatcgcaaatcatgcgtttatgtaacttgagtataatatagcaaacttcaaaactatttacatgagtaacacgaacagcattaccattaatgagataatactgcccctttttaatttctttatcaaccacaaccatatcaattcctcaaaggcaattcatgtgttaataataccacagtttgagcttgttgtaaacaactttgtgaaaaatattttagggaatgataagaaaggaacgatagcttagaatggtaatatacagaatgtaagaaagaaaggcccagagggcccgccttagtcttctatgatatctctatcatatccaagtgaaatgagagtttctttgaagtgtttaatgttcttttgtctagaatcattgatgaaaatgactggataacgaatgttaagagatgtgaatccagcgcgtttagcaagagatacaatcagtggacgatcatactcaatcttaccattatttgtaagaactttatagaaagtaaaaggagcattaagctcctttagaagttttgtaactgattgacatccaggacaacgacctacttcatctggaattccatagacttcaatcttattctttaagttcgagttttgttccacgagaaataattccttgataagcccagtatggcgggttaacagaatcatcgccagaattttcttcaggaaaataaacctggataacaaatccagatgcatcaaaggtaaaataaaccgtaggtaattcacctaacaattcagcacggttattaatttcttcaagttctcgttctcgtccagcccaaaaactaggatttagactacattcatagaaataatagtcattaccgaacatatcaaaacccttccaactctctaccacatatcgctcaaaactaatcataattaggcctttttatcaagaacagcattcagtttgttagtaattttatccagacgctcattgaactcgctagaagataagcctttttctggagaaattaagctaatcacgaaaaatatagcaataaaaggaataagaaaaatagcaccaactgccataaacaaaaagaacgttacagttgtaagaaaatcagctaaacctttacgaaatttatacatattttacccttaattgattaaccaagcattgataagcactaaactatattgcgaataaaattctggaccaaaatgaaaaatcatatcatttatagtatccataatgtaattcaatttaatcatgtgtccacaccccatcggtatttgaccaaagtcgctgattatctgatcctcgccacagctttttggtcggaagatttttctcatacttcccatcaataataacatcaacatatttaagcatttctagttgtttaatatcttcaaacttatatcctgtccacaaccaaatgcttttattgggataaagatttttaatagtttgaaccacagagtgaatcacgtctctgttatcaggatagagagggtcacctccggttatagtcaatccttctatataatcattattcaaacattcaattaattgttctagtgtttcaccagtgaatggaacaccatttctagcattccatgtcgatttattataacacccttcgcatttatgcaaacaacctgtaacgaaaagaacgaccctgcatccagggccattcacaaaatcacagggataaaatctatcgtaattcattggtgtttaaccctatgcatgatttctttatttttaccgagattaaatccgcgttcgttcggatttcccaaataaccacatgttcttcttattgtgttcatctttttaggatcagtttctccacaaatagaacaaacaaatccgttttcagtaggagtcatttcatgagtacttccacatgtaaaacatttatctactggcatattaacaccaaaataatctaaatgttgtgcagcataatcccatacggcctcaagaccctttaagttatttttcatatcaggaagttcaacataagaaatgtgaccacctgtcgcaatgaaatgatatggcgcttcacgagaaatcttttcaaacggagtaatattttcttctactgaaacatggaaactattagtgtaccagcctttatctgtaacatcttttacacttccatatttttctgtatcgagtttacagaagcgataacacaagttttcagcaggtgtagaatacaagctaaaagcaaacccagttctttcagtccattgtttaagaagagcattcattttagttaaaatttcttgtccaatatcacgtccgacaagaatattcaattcgtggataccaatgtatcctaaagacactgaacttctaccgtttttaaataactcaattatgtcgtcatcaggtttaagacgaaccccgaatgcaccttcttggtaaagaataggagcaacagtagctttaactccttttaaggaactaattctacacatcaaagcttcaaaacataaatccattcgttcattaaataattcgataaatttctgttcattgaactgtgttccaatataagaatctaatgcgatacgaggaagattcagtgttacaacaccgagattattacgtccatcaagaatttcattaccagtcgaatctttccatacgctcaagaaactacggcaacccattggagaaacaggaatagatgagccggtgatagctttattgttcttagctgaaataatatcaggatacattcttttgcttgcgcactctagagcaagctgcttaatatcgtagttcggatcgtctttataaagattaacaccttcttcaacgaacataacaagcttagggaaaataggagttatcccatcacgaccgagacctttaatacgatttttcagaattgctttctgaatcattcgttcagtccagtcagttcctgtaccaaatgtaattgttacaaaaggtgtttgtccgtttgaactaaagagagtatttacttcatattcataagcttggaatgcatcgtatacatctttttctgttttagattgagcataattcaacgcatcagcgatttgccatttttctgcatcctcaatatgttttgcataggtgcgtttaacataaggagaaagtactttatctacattagcaaaagtcgttccgccgtattgatgggaagcaacctgtgcagtaatttgtgccataattgcagtagcaacgccaattgatttaggagtttcaatctgtgcattaccaagcttaaatccgttctcaagcattccttttaaatctactaaacagcaattagtaaatggaagagcaggggaataatcaatatcatggaaatgaataattccgctttcatgcgctttcataataaaagacgggaccatatttttggcaatgtgtttagacacaataccagccataaggtcccgttgagttggaaaaacacgagaatctttattagcattctcgtttaaaaggtctttattagttttatgaatcaatccttcaatttctttttcaattgtcattttaaactctttctaagctgcttcttgaatgaagctattaattgtgttttagtgtcagattcattatattcaaatcctctttgaagcatctcagccatcatttcctcttttcctaaacgagaaaattcctttgatttatctccaacaaagttaggatgaatattattttgggtgtaatcggattttaaataagtaagtaaattttctaaccattcaagataatcaacaccttgcccctttaagccagaacgattaaatttatgtttcatttgaccttctgcggcattgcagagattacaaagcaatccacgcacctttcctgcttttggtccatttaattcatggtcatgatcaagatgattagcttgaacatcaggatttagttctcgttggcaaattaagcatttaccgttttgtgcatcataaaatttctgtttttcttctttgtataatttgccagtcaataacataataaacccttaccttaaatagataagggtatttattattttcaagtattgtaaaacatttgattcaatcgcttatattgccgaatcttttggtcagaaaaagaaatttgggtttcaagccattcaatatattctgccgcagcttgcatcaaatttccttcatagccatcgttattttcttgtgcagctaatttagctaatgcatatgaaatacgttcaccttgaaaatcagctttaggcttctgaacaacttgattagttctatctacaacttcttcaatttcgccattttctactgattcagtattccacaagcaccaatacgtaattggcttatcgtagatgttaataatctttccatcagaaagttcaatttcaataattccagtatcaggctctatatcatcttcacattcttttgcaagttcacgaactttaaagacagtacctgcactaagttccggccagtaattacacagccctgtatcagcacgattaattctaaaccacttatctactgtaatcatgtcccatctccatatcaattaagtcatttatcgttggttcattatatattgtttcttcatcagtgtaaaccggttcttccggctctggctctacagtttcccatctagccgcccaccaaggttttatagcgtaatccattctcgtactgtctgagttactacacgttcatggggctcgactagttcaacagtcggaactgcataataccagtcagaatggtaagaacctgagcgagattcatttacagccacatgtacattatgttttggactaaagtaaacacactgacgatattgacatttaccatcttgcacccagtcttctatttcgacaggtttaagataatcggaaaaatcgaaatcatagttttccgaaaatgcatcatggtcttcaatgatttcgctcagaactgcatcaacatctaatttattttcaatagtcatttttcaccaattaatttcgcaatttattaagttcttcatcatcaatccaggattctagtcctgatggcagggcacattcaatttcccaaagaagttcttcaattttatgaagacgatctagttcttcagcaggaatagtaaccattgacggagctcgtgatacattaatatcgtaaatcatatttaccccaatttaaccatacaatcgccgtatttccacttagaaatagacttttcaccattagaataataaacttcgagtttagcacgattatttttaatttgaataacctttgctgtcatcaaagttccatacccataataaactgcaacttcatcacctacatataccgcgcttccgcggtaatcatgaatatagtcatttccttcgagcatcatttaaaatattctcgcagttggtcaaatccaccaatatgacttccatcaggagcaaatacttgtggcattgtcaaaccaatttgagtatcacgacctagtttcgtcagaagctcagcgattttctcatcatcaaaaacacctttttccggcataatgttgataaattcaaatggctgtttcttcacagtcaagagacgttttgcattatcgcaatacacacatttatggatgttgctatcataaccatatactttaaacatattattccttaattcctagtacttgtttaaaagtctcgtcgtaatcaagactttgacctgtttgttctttatgtttgtatataatatcacttacttctgatagcatatttttatatgaacgagttaaagcagatttaagcacgctatatctatcaggaaatttaccatgttcattataatacgctattgctaattcacggactgccttttcagcagtctccatatattctttacgctttgtcattttaatccaaaatattattaggcattggttgaacactcgcaagttctttaaagaactcagtagagtcaggtaatttaaccatttccggagcatgcttactaaatttatgtttgcaatgacggcatttatattcaagttccggtttacgccagttaatcaattgaacttgttcagtaccgcattcaggacaattaggaacgtttttagaagccctttcgcgacgttcaaccataaccataatagcatcccaggctggaggtttaaaatctaaatcatcacaaccatgaatctttccgcgcatttccagatcgtcttcttcaccagccataataattttaattagactggaattacttgaagctgcaatatcttctaatagacgctttttcatttcaatacctcaatagcattacgtaaaccatttgcttttgcattaagagcttttaacaatttagtgtgttcggcaatctgagcttcaacttcaactagtcgagatttgaggtattcacgttcttcgctcaagttatcaatcttttctactttaggctcttttacaactgtcttatatgtattagggttcttcagtttaattaaaatgcgtgaactgtataacattgaaccattatcttcggtttcgtcatacatttctactacgtccatgatttttaacatcatgcggagtttataagataacgaacgaatagttttgttgtgcttattaatttctctagagttcatggtgccgagattacgtgagtaataataaggaacctggatattaattaatactgatgaaccacctggcttgtgtgttacttcatcagcaataacccagtccttaacatgaactgtatttgtacggtcatcgcccgcggtaaatagtttgcgagcatgcttaaaaagcatattcacttggtcattgaattgacaagcaaatttatcagcaaatttagtttcaggaatggtagataaccaatcagccaaatgggtctttttaacatcgttaacaatagtaaattcaaccaaatcagttatagatgtctcagatttaataaagctcggcttcataaagtttttaatgttatcgcgagctacagtagaagataacatacgagaacgtttaaaccattgaagcaaattgcccaacgaatgagaataagcgttttgagtatctttacagatatgattttcctggccaacatattgaaggaaatcacgaagaatattattgattactgctctgtgtccgatctgataattacggtgtttaataataagactgtcaaaataatcaatataatgtttacgagttttcatgttcttctcacttggttaatgatttatactccgagccatccttggctttaaattacttaattaactgtaaagcttgttccaaacgatcaaggcgattaacagattcttcccaaatccttttagccttctcatattctttctgcgctttattagaaatttctagaacttctttataagctttttctagtgcaataacttctggacgaatttctatcggttcaggcgaatcgtcaagacattccattagttcttcaagggtagtttcttctttaggagtattcacaatttcatcacatttttgttggtaaatttctttatcagtcggtgagtacgtacgtttcacttcacgaaggctaattataattttatatccttcccatccgcatatattcttaaaaggatatgtatgaatattttctactgtttccatacaaagtaatgcagtctctaactgacgagttatagtgctagcaattgagaaaaatttattaatattcttttggttagcgtttggtgtaaaaaatccataattcacaaaaatagctactttattttcatcaagctcatattcttttacgataatcatatcagaagccaaaggatgaatttgacgataatcgccataacataatttagaagctgattttagaatttgtcctttgaaaagtctgaaattactaatccaacgacgagtaaaaatattctcagggtcttctttattattaagatgataagaattaacatcaccgaaccaattatatcctactacatctttggttcgtttaatttctttcccaaaattaccaagaatatcccgattaaccaaatatgaaagaagacgagactctttaaaagttttcttgataacatctttatctacacggctagaaattttacgaatttcatgaataaatttagcagaagaaacaatacttgcatcaacactattgagccattgattgataatagaaagaatgatattttgaccaaacatcggtatagctttatcatcaataacgctattgaatgatttgatatattcgttacgagtcataataatctcctcagtagaaagtaagaacattataccacatccttgtggcaatgtaaactagttcagtgcatttagtgcattgttcagtttagaacgttgcttcgtaagatttttgactttttcttgagctttttccaacatcttttcagcttctagcacttcattagttgctttaacgagttcatcatctactgccttgatagacttctcaattgcatctgcatgccatttttcaacaggtttaagactcggattttcaataggaagaaaattcactttattaaatttccatgcatctttattacctgaactatacatccaaaatttaggatcgtttgataagtaattggataaatttaaatttaagttatcttgtacttcctgctttttctcttgcgggacttcgtcctttctcaaaaaatcgtatttaaatgaaacgatcatatcaagttcatatgatgttgtatctaacttaaatcgttcaaaacgaggtaaaatcttagattgaacagcagcaacaacatccatatacttaaatgcttctgtcaactgtgatttaaggcattcacaaattgaaagagaattttttgtattaggtttaaagctaattcgtgcagttctattattttcttttaatggtcttacttccatctgaagagtataaccatcaaatttcaggttctttaagttaatatcagagccttttaatcgactagcagtagacaaaatttgctttaattgtctacggaacagagcaataaatctccattcaatacgataatgattcggattgaaaaatccagatgataaatcgaccttactttgaccaacgccttgaacaaatagaggatttttataatcaatagttttacagaaatcggtgagctgctcacgagcagtcatttgagtaatataccctgcttcattaaaatgacgtaaccattcactgctattcatatacttaaagtgaatatcacgattaactttatcagggtctaaattattttggcacaaaaatgtcataacattacgggtatagctggcattacgaaccatatcttcaatttgagaacgagttttcatagtgttccttaagatttaagtaaatcaacaattttaattaatttttcacgctcagatttagctttactactcaatccagatagtctgaaaatttcatcgtcatactgttgaatagaaatattcagctcttcaatttgcttattaaaataatcaatttgctcggaatatttttcattactacgaactggtacaggttttgtaggcaatttagttaaactggattcatccgggcgataaattaaaatacaacttgaaccaatcgggcatttagcaccagacacatattctaatgttccggcttcttttaaaacttcaaaagctaaacagagatgatgccccatattaacataatctgtagagcgagctctgacgtaataatcatcgccgcgaatactaaatttaaagcatttaaggtcttctgtattattggtcttaaaaatcatttgtttatctagacctttagctaatctagcgcctaatgctaataatcgtcgttgattttcccacaaatctgcgatcatttggtcaaatgataatttcggcattagtcgaccgtaaaggtcatatcctttattataattacgaaggatttcactcgcgttaatacgagacaatgctccaattttattaagggctttcataatgcgattagataaacccattccagacccgtttgttcgttgtaaatgtttatctaatccaaacccaatatcaactttaaatttatctaaaatttcagcatgaacatctctgtcaataacattcaaatccaaagttgggttaaatctatgaaaaaatttatctggctctccacgacgaagtacagtccattcattcaattttttattaactaaagatttaattactgcattgacattattaattactactgacatattttcctcactcaattttattaattacgcggaataagattgaacaaactatataagtaccacatatagactgaactaatgccattccaaagaaccaaacaatattatcaaaccatgtctgttttacgtcgaaaggacgtaaacttacagtaatattatcacctttttctattgaagaatacatctctggggaaatatattcactaaatctataaccgtctttgagttcatatacagcaataaacgataaactagacccttttccttgtgttcctgtaatggtattaactacagtaacatcataatctttataatgcatataatcattaattacgtaataaccatatgcaattactatacataaacaacatatcaataaattcaatcttttaattatcaactgtttcataataatctcaattaaaagggcttagaaccattataccatccttggtataaagcggttatgcgagtaccgtctttaaccgttcttcaaacttccgaagagtattctggcgttcagctctttgctttttgtaagtttcaatacgctctgaaatgagagtgtatcgttcatttactgattctttcataaaatcaggaatttcacgagaagctttaatctcgtcaaatttatcaataacagcttgctcttcagcaattaagttatcatacatcaaaatatctttcttgatgaactcaatatcttcttgagttacacgagataatttagatgctttatcctttttgtactgttcgttagtatcacgagaccagtgtaatgtacgatttttattcgtatttttataaatttctacgataccaatctcatcaataataacgatccaattccaacgggatttgtaaatttgtcctccatcaaccgtgatttcacctccgattgagatgtcattaaagaacttgctttgtgcttctgatttaaatttaccatcgttgtaatttaccaggttgaaaatatctttagcgttcattttgtgttcctccgtagttgatagttgtatagtaccacagaggaacggtcttgtaaacaactaaaagaaacttctttcacaattttttccactgaaccatgcgctgaccgctttcttagtctcaggagcagtattatccataaaccattcaaaggcagcctttttatgattctggagggcttctcgggctttaatctgctcacggtctattaacactaacatatgagcctttcttgtcaccaagggcttcttatgattttttgaatactcccagtcatttgtccatcgcatcgttgttgcgaactgaaatactgcttctttaattttagtttcgtaaatttcacgagcctttgagtataacatcattacctccatttactagtttaattctagtcatctttttgatggcagtccatataatctatttctgaactgcctttttgtcatagaaggcctcttatgaattatttcagaagagtaacctcagcgatttcttcccaaccgtttttgtcggtcataataaagtcagcaagataaagtgcagtacgcagtgaaacattgcgtaaacgattaacattgactttcatccatgataatgctttataagtttcttcatcagaaagaccgcgtttttgcatcatgtcagttgaaagaataacatcttcaaccctgaccataatttcttcattagtgtgaacacccaaatctaaataaaccgagcgggaaactaatgcttgtaaatgtggagcaagtttagtaccacggtctaattcgcggtcaatgtcaacgtttgtgataaaaacaatcgttcctttaaattcaaactcacgctcaatgcctttttcttctaagtaagaagatgcagtgctccagcagactttgcgggtctctccggtgtccagagcagctttcagaagattaagaatgtccatatcagagaaaacatccacatcatcaatcaaaaggacagaattctcttcacgattattccaaagctgttcataaagaccgataccagagattttaccattaatgcttttatattcaatgtatccaatatcatttgctttatttaaagctttatctaaagaatacgttttaccaatacctgctgcgccagagataattaatgaacgaatatttccattaataataccattcgtcatcattcccataacattaaatcttttattaatgcgggttttcatatcttcatacgattctttaacttcttcaacttttacaccatcatatgaaatatctgatttgtaaacccaaacaccgcgacgtttaccgtcaatttcaacaaaaactttaccatctccttgtgcatctaccggagcattatctgggaaccattcgcctaagagctcaaaagttccagagatttctttgccaaagtagatacccttattgatagttacagttttcattttattctcctttgatttgataggactactataacatagtcctatcagtttgtatacttattttgacatttcttcgatgtcacgacgatacccgtcacgaacttcacgaagagcttcaaggccacacataggctcgataccagtaatgtgaacttgattaatctgatactctacatcttctaactgagcgaaaacataacgacgttcagctgcacacccagatttagctttaccgaaacgtttattcaaagtagtcattttgtatctccaatttactcatttgttttgatagttgtatagtaccataaagctttatgcttgtaaacaactttgtgaaaaatttttgaaataaaaaagggagcccgaaggctccctatcatttataataacttcggtggttttcaagatagaccttctcaaggaagtcatcccagaaacccatgtctactttttgctgcataccgttcttagaagcttcagtagatgctgcttctacttgatcgaccacatcttccaaaaactcttgaactgttttaaatggatgtttacccaacttcacgtcgagaataaatggagcatcttggagtggataaatcaagtcgccagttttgtaaatttccaatagttgaagtccaccacgacaagcatgacttagtgctttccaatcaataccttcattagcttcggctttacgagcacgttcaccatattcagcatctaatttgttcagtgactgcttaagctcaataagagaaagcgttgtctgatatttacgacccagcactgtatagaacgtttgtggacctgttttctcatgattatggaacacccattcacagaattcgttttctggaagacgatgcttaatatcttcaactttagtacgacgctgcttaatggaaccgtcttcttggtaatcaacccattgctcagggatttgattaactactttcaatacatcgcgtaatgcagccaaacgagaacccttgacaccgtatttagaagcttgcttgcggacatatcctaaataggatttcatgttagtcgtataaaaacgagaacggttgtcttgaataaacttccacacatcaggcaaatcagatttaaccactagttcaggtggagtgtgaagcatatctaatgctacagtttcaccatctgctgctaatttaaagaaatacttaagactatacaattcgtggtcaatatcatctttagtgtttttagatgatgtgttgttggtatttttactcatatgctctttaacatttccgataagaatatcacgagcaggaggaacaaagatttctttaaaatctacatcagattctggggtagaagttccataaagatgactaccaaaatagcttttcattactgttttcatcattcagccttatattcaataacaggacatactttagctttacgagcttttaaaaattcaacgataaccgatttcttgggttgaataggaggtaaacctttatacgccctatcaatattttctacgtgtaaagcataatcctttttccatttataatctttatatttttcacgcaaatgtgcaggaataacaaatgaaccgataataagtaaaacaaccaaaagtgcaagtataaatgccgatggaagaagagtccataaactaccgaaaataagccaacgttgtaggctttctgcacaaataattgttagccctacgagtataacacatccaaaaatagaaacgaaaaatgtaggaatggcaatagaccaaaaatatgcgcataatgtcttaggtcgttgccattcatcgttaaacaatttgaataatttatagtgccaagagttttcattaataatcataattatcctttcattgaaggcgtaacggttgttaaatacttaatcatagcttcagcttctgattttgataatgaaatttctccattgttttgacgaatagaaataaaatccggatgacggtcaccaccagcttttaaaacacacatataagtatcaacttcgccttcaatatttgaaatgattgaagcagttccacatgaatgcggtttttgataaatcaatacagcttttcttccaccgtttgactgttcataaacttttaacacatcaagcaaatcagttcttttatcaatagctaaaatgttattttcatcttcaatgttaaatccttcggatacttcataaagtgtcacccataaatcgccaatatcaataacagcgttcacttttccatgactttcaagagcatgacaaattttcttgatttcgtcataactcattttaataatatcatctccttgaataagaaagatgtcatttttaaattcaacacgaattaaaccactttcacttgaaataaacatatttcctcactttgaaatcatagttggaatgacagaatcaagataagtctttagtgcaatagcttcgtctttggtaaatgtgacaatatgtgctcgaaaatcatcaatttgacgaatagttaagacatctccatcttcataacattttgatacgtttaaaacagtttcatcattctgattgcaagcgttagtaataatagcattgcaatttttaaaccattttaaactatgttttctttcattagaataataaaaatatttaatcttatctataaaactatcccaatggataactgataagcatattgactcgctttcaatattaaatcctgggcatgaagaataaaaatgaattttatgctcatcattaatgcttacaattttatcagtataaggattttcaattttggttaaatgaatgatttcactaggcgtaaaatacagcatatcgtcttcttgtgtcaaacgatacatattatttactttttctatagccaattcaccaaaaagtgaactaacttctaatactaatcgtttcgccgctaccgtcattacatactcctctgaatcatatcaataatgttgttcaccagattataagtaaacattgggtaattatattgaatcaccacatacacaacaaacaaaactttcattctcttctccttggcagttgacaagattactataccataaccttgccaacttgtaaaccattaaatgacgttttcaataaaattctgaagctttgtgtgagcatcaaccatgattttcatttcttcttttgcgaaagctgtacctctttcccgagcagaatactcatagtcagaaactgcattagcatattcttcaattagcttcattaaaaacatctgcttttcagttttcattattccacctaatcatttcaagatattgaactaacttagctttggatttatccaaatctcttttagctgcttctataccgtcgtatgaatatccttcacaatgctcaactgctaattgatatgaatctatttcaatatcacgtgctaatttaatgattttttcaaactgttcacgtgttagcataattaaactctcgtattatgatcgataatttcatcaagaaacatatctaacgcttctaaagcattatcaactttagcttcaagttcttcaatacttttatttgcaatgcctgacgaaaaccaagcaaagtcactaagttcctcatctgctttacgaattaaagctaccaattccttaattttatccgcttgttcgatactaatcattattccaccacatatgaaagagagaatattgcacacgccatgtgagttgcaacttcatcacacatattataacgtttcttaagaaattctacaagttcttcactagtaacttcatccatgtcgacgaaaaaatcaccattaatgatgacgtagatatttccttcttgattgagtgcttcaattttcatgatgttctcctctttatccgatagttgtatagtaccacagctcaaacggaaagtaaaccggtaaaatgaaaaaagtctcccgaaggagactaatgttattcgagggaaagaagatacttactctggtaaaacattccagtaatatcatctatcgtgctttggatggctggaggcatttctttataaatgctgttagattggtctagtatgtgatcaatcattttaattgtgtcggtaggaagtttactggcatctggaattgaaggtgtgtattttctaccagaataccccaaatattgctcaccaaatttatcaatcaaatctggcaactcggagaaaataaaatcgtatgctttgtgtctagcataacttttagtttcaaaatgtgcagaatgaaaataagcttgtgcagccattaataaacctaagtattcatctgcctttgaaggttttccactttgtgaaaagtcgctgaatttcattcagtctccaatttaatgttcataattctagcgtatgattgtgccatctccgcgcctcgttctatacattcaaaatcagaagagcacgggtcatttttataggtcgttctcataaaactatagaattgttcagacgattctacgcttttattttcaaaaagcatataaacgtgcctaataccagattccataaatttatcaaaatgaggatcgacattcgcttcaatcgatggagataaaacaaatgacaatcctagcatggcaaatagtgccgttgcttttaaggccataaaggcctcctatcatttttgtcctgtatttactttatgccgatgcacggccttaactttatcaaggtatttttcaaaatttcgcaatctagtatagtctgccggagattggttgagtgatacttctcgacgcaaagctgaaatgatatttccaacttccctacgaatttcatctaattgaagcacagtaagattgcgaagttgcttttcagttaattgtagcatatatacccctttagttagataaacctatttataacttttgcactaaccaagctttttagttaattcattccaatgttttctgcacaaagaaacataaatttcatcaccaatacagatttgattaccttctttaactggtgttccatcttccattaatcgagctgtcataatcgcttttttgccgcaatgacaaactgcctttagttcaataagtttatctgcaatcgctaaaagttctttagaaccttcaaacaattttccagcgaaatcagtccttaatccataagccataacaggaacattatatgtatcaacaattcggcttaattggtgcacctgttcagtttttaaaaactgagcttcatctacaaatacgcaatgaatatctttttgtgcttcagcccatttatagaactcgaaaatatccatatcatctgtaataatattcgcttcctgtttaattccaatgcgagaaacaacttcacagacagaatcgcgagtatcaatagcaggcttaagaactaatacactcattccacgttctttataattatgtgcagcagtcaaaagagaagcagattttccagcattcattgctgcataagtaaaaattaaactcgccatatcaccttcttaaagcgtattcacataagctattaattcattttctttcttatcaaaccgatcagcaaattcttcctgctgttcgggagatagcgggccgtattcatcataaaaggtgtttgcttctgcatgctcatctagaagttcatggataagctcaaacaatttatctttttgttctttgcttaggctcacagtatgtcaatccccaaaagttttaaaatgactcgtttctgattcataaccgctacgattgaatgaccgttggggtctttttgacccgatccaattataaatcctttttgtgcagaaagttcaatcaaaacatcaagttcacgtaataattgatattttaaatcatcattcattttggtttaccttctttaacgaaatcaggataagggtaaaatcctgaataaaatccttcacctttatgattgatgcatcctttattagaacaatagcaccaataatcgaaatcacaagccatttcatcgttgcataaagcaaaaaacaaccggccacttacacttttcacagtgggcatttttaagaatactagtttggctcataaccatgtaacctttaagcaatattcttctacatgttgtttacgacctttcttatcaataaaggtatattcaacgaatgttccaatgtagtctttatctacatcatgtggactattaattggacatttagtacggcaaatgcgttcccattgacgaataattactgctttgtttttaggatcaaacggatgcgggtaatgcactttcataatccaccactattaaatcaatatcaggagtaaacatgtcgattaatttagaaaccttatcccaatcgccgccagcaataccacaacctatgcgtggaatgtaaattaccggtttaaacaaaagggtttctgcctgtagatttaattctatcatgcagtttactaaagcaccataatcaagattaggacctggttcgtattgcgtatacaagttataacatatgccaaaaccattaggtttatgtttaaaaacaatagacatatcaccgagtttttcacgcgaaccatattcagttgtggtcttatctatttctaaaattttgggataggctcttgctaattgaccagctacaccactgcccattgtatgaaaacaattgcacccgtgcgcaataatattaccttcaagaaagagggcgacaatatcgcccttgatatattttacaatcatctagtactcaatcctcgattataagaatctaccaaacggtcaaccattgaatgacaagcggctttatctttctcctccgcaactgaacattctaaggtattccactttttagcatatcgttttaacaatgtatcatttttgtatctgcttgatttatctctttctccgtctttatatgcatatattaatttctgcgcaaattcagcttggcatgctttatttttcccgcaataatccgctgcagtacggtttacatactctctaatttcagtatatgatgtatctgctaacgcagaaaatgaaattaatcctatacataaaaccaaaattttagtcatttactatttccaaaagtttattatttttaaggtaattagccttttctaggacttcagaagcatatttagaacctgctttaacattccatcccgaattataagaggatattgcttttcttatatcgcccttatgtatatttaaccaataagaaagttcaatgtacgcccaggaagctgaattggaccgtttattcaacattctttttatttcagcatcggtcatattataaccaagttccttaactcttgctcgcatagtaggcaaataattttggaacattccgtaggcgtgatgctttggtttagattttaaattaactccgccagagctttcttgccataaaatggcagccattatatgacctaatccgctcttgtggatatttttgtgtgttttatattttccatccttagaaaattgttccccgaattgatacgcgtaacgcatgttatcgagttggacattactgaaagtatgctcggagctatgtgccatcattgaaatggccaatagaccagcgagtagtgcttttctcatgtttacctcattgagttttaattactgctttagaagcctttcctggtaaacgacgactgttgataattgccatcctgcattgaagtgacgggtttttgaacttctcattaggcttacaaactgtaaatccaagccaaagatttccatctgtgatttctaaacgtccaggacgatattcaaccccatcaataaaatcctcgtcaatgtcaggacgcggaggcatactcaggaattcattaacttctaaaacatgatcttttattttatggaataattcaaaaacatatgtctcatcaatctcccgttgaattgcacgatcaagaagatgctgagaatattttagatgaaacgatgagacccctgctgcttttgatgcctcacgaatctcattgttaatttgacgaaactccgactcaaagtgacgacggagcttatttcgacggataaaaacttctgtgttgatagtcatgttattctcctcttaactgatagaaaaattataccacagtcaagaggaaaagtaaacagttattctttaaatctaatcaatttattcatagactttgaaacttctgcacgaacctcatgtaagtttttaagctgttcaagacgctgctcatagtaagcaatttcatcttcttcgagacagtcctgtgaatcttctttaagataacgtgcatagtcctgaaaagctttacggactacttcctggaagtcatcaagactttgaattttcttaggagcggcagatacacgacgaggtgcagtataatactcataaccaaaccctgcacttaattgagccattagtatttttcctctggttggaacactgcacgacaagcccacatactggcttctttgagtttcgttttagcaatagttaactgatcgaggctttcagcataattcttcgcgagttcatcatcttcacaattatctagtgcttcccagaattcatcgtataaagcgtcaaagataagtcctaaacgaacttcagcgtctttaatagcattcactttaccgattttctcttcagtatgcggcttataacctttaatgtcttcaatcatatttgacttcctcaccagtacataaatcatattcaactaaacgaataggttcatgaatgccatatccttgaacagaaatttctgtcgtaggataaattccatcaatatcacccatattccaggcttcattaaattgctgttcgcctgaattactaaaccactcggcgaaagcatttagcacatctttagaaccttcaataattatctttgccattacaaactctcagtaaaggtacgagcaataacgtcgcgctgctgttccggagtcagagagttaaagcgaactgcataaccggatacacggatggtcagctgcggatatttttccggatgcttaactgcatcttccaaagtttcgcgacgcagaacgttaacgttcaggtgttgaccaccttcaattttaactgtaggctgttgctcaatttcaatttcacgggcatgcaaaccatagaaaatttctgggtctacaaaagagtcctctttaaaggttttagagacaataattcgtgcttgaataccatcttcaaaataaatagtacctttatgtgtgccttcaagaatttgatatgctttcatataaacctcaattagaaaataaatttatccaagattgttctttaattaaaaatggctcagaatcatatgccattaaactttgggtgattagtcctttaaaaggtccatcaataaattccatggtaaaatatggaattttattcattaactgcgcgttaggagcagtacacaaaactctgcatcctttgaatacgcctttttgtaatttgtattgcttaggataaaattcgctcaagacgttgttatttgccaaaatttcaaaatgattcaccaatttatttttaatagtttttggcgaaaaataaagatattcgaaaagctgtgtgtctgtcatcattgcattccaatcacaaaaaattgaggacgaactgtttcacctgtttcagcattatagcttcgacaacagtgttgcacagtttcaatatgaatatcgtaaattttatccatatcaggagatttaacaggctcatcaattatatacaaaattcgtgaaagcgataaacctctgaacttgctacctctattaccaataaaactgcgcacagaatcagtaaataaacgaaaacgtatatcatcattagaataacgcgaaaattcctttttaatgttatttgcagaaattttagcgtaagctgaagtattagatagaacaataactgttccgccatcatacagccaattagcagcaaagttagtcacagcaagtgatttaccggattgacgtccaccatctatacgaagtgtacagtactgtttaagtaattcttcaaatggcgggatatattcgtttttacaaatttcttctactctagcatcagaatggtgtgtaaaagcattcatcagggatagatacgggccagttaaaaatgttttcatattttctctcttaatttttgggccattccatggcacatgagttgtccattcctgcattacccattaccgcgctttggctcgaccttatcacaggttggcgggaatacctcaaatgaggtccaggctgttcccatattatttgaacgatttaacgtactgaacagaacctttactattcacgaaagcgattttaccatttttgttatacatggtagcagtacgctgataaccataagtttgtttaccagattgataaccaactaatgcgaaattatcttcgcccattttattctgcttagcgcgaatgcgttcatggccgtgtgccataagaaccttagcatcaccagttgcaatggatctacgagttttttcatcttcaactgtattaacaaagtcgtcaaatgaatcaaatttagcatgagatttattatacagttttccatctactgcataattatatccctgtacatccatctcaacttctgtaccatcatccaatacagcagtgattttttgaccttttttaaatttcaaaaggatcagtaaaagtttcagcaataatttgagaattaatagctgcttcagtaataaattcttgatatgttttcatatgtttcctttaatttttatgctttaggaaaatttttagaatatgcatcgtaaagtttatttccaatgcggcggaaaactctagctgcaaaacgattttctggatttttaatcataatttgcatcatataagtgcccgcgtctgaaagagcttcactataatatccattaattttttttaaagttctgcgtttccccccaggaccatcgacagtaattttccatttaccagtagaagtacgactaggtggctcaactttttcaatccaaatataaccgccttctacacgttgtcctgcggcagattctgcaataaattctttatacgttttcatatgtttcctttaaatgtaaatatttttgccgtaatacttgtaccagtgtggcttcattaaaattttttcatcgagtcgttgttgactcaatttaatagctgatttgcatggattataatcatttttccattctgctggaatatcactgatgtcaggaacttcagtatcttttatactaaacccacgttttaagcattccgttataatgtctgattgacgctttcgcaaaaattctaacttatcgtaaaagaacgtaacatgaccagaacctaaaataaactcggaagatattttaaaatctttaacccgcttaccatttgccacgtgtttacgaactataccaaaaacacgtggcaattcacggtattctgcgattaaatgctgatcagcaagttcagatactaaagtcaaattaatacgagtcattttatccctccaagtaactgtgaatatactatcacagttctaggagaaagtaaacaactttatagatttttatacgcgtcccacgtaccagttctaaacgtggcaatgactcgttttgcacggttaggtgtttgattataccatctacttttagctaagttaactgctgcttcatcccagcgtttttgttgaagcatacgtaaagaattagtaaatcctgctacgccggtttctcccatttggaaaaccatattaatcaatgcgcaacggcgaacagcatcaagagaatcataaactggttttaatttagcatttctcagaattccgcgaacagcagcatcaacatcctgattaaagagtttttcagcctcatcttttgtaattacaccattgcaattacgcccaatagctttatctaattcagatttagcaacacttagtgatggacttttagtaagcaaatgaccaatgccaatagtgtaataaccttctgtgtctttatagattttgagtctaagaccttcatctatacgtaacatttcaaatatattcataatacctcctaagtatttatagaaggtatttataaattaaaagaggctgttcattattcggtaaagtgaaggacccatcacatattgccactgagtacgaggaataagggcaaaagcatccatctctggaatcataacaccatctttattttcaaaataagactcgcaatggcaatttctgaacatctcatgctctactggaatcgtataataaaataactgtaagtctttattactagaatatttaaatacacctaggtcttctagaaggtctggattataattgttaaaaccagtctcttctgagcattctcttcgtgctgcatctaatgcgcttaaatcagaattttctacacgcccctttggaatatcccagcgatgtgccatcattccaggcttacgagaaccagtaactcgtcccataaataaatctttatcttctgtcataaagataataccagctgataatgttttcattttaatttcctgcattcagtgataaaattatttaaattttgagtatatttcttttcatcaaaaatcttttgctgcctacgtaaccgccatggcatttcaatgaacacgcaccatattcctgatagtactgctgctgtaaaaatattaacaagtataattaaaagaatccaatcttccgttctgcctactggactttctccaaagaagcaaaatacaaatgatgtcacaggaaaactaataatataccacagaataaccttcttatctgtgaaccaatcagcgttcgttaacttagcacgaccattttgaatacacacgaatttatcatctgttacagtagatggcttaactgcttgatatcccattctaaactccctaattaatcgtttctttgtatcttcagaacagccgctccagtcaactctatcgactgaaatgccatcgtccccatcatctaaatcataccagcgagtttttaaaatcatttgattttcctacaatcattcacgaattctttcattgattcattttcaatataagacatgtagttattatattcttttaattgtattttgtaatccttttttctttgccaatttattttaaaattatcataatgaaaatataaaatgatactaaagaatgaaaataatgaaattgctatagtataatgaagttcactccaaacttctattatatctactataccgctgacgttactgcggatgtttaaaataatacagtcaatcattaatccaataagactaccagcaagagctgcagccaacgccacagcaaaaattaaaaatgactcagaaaaagaatatttgactttatttagttttggcttttgcatcgtgattccttaacaaatttcataatttcattaaattcatacatatttagtttaagctggtgttcctttttaatctttttacactgagctttccattcacgtacacgtttacgataatgccttccttgataccaatatcctacccaatttacaggtaccaataaaaatggaactactaatggaagaattaatactaacaaaaatattacgtcagattcaatatcagtcataaagtctataaccattccaacaatcaatagaattacaaatgatatagctgtcacaggacctattaatacatcagtaggaattagctgacgctttagttcatacttcacaggttcacttggaaggtatagtgatggctttgacatattctctacattccttaacaaatttttctaataataaatcgctttcaaaattaggattttctacgaatttatcaaaaagatcatcgacaatagttaagatattctttttactaagaatacgtttattttcatgcttcgtttcagaatcaactataagagtaaagaaatatttcttgccctgaaattttacagtagtatcaatatagaataaatttgacttttgtaaattacgtttaaaccatgcgtcacttaaactataaacgccaagataatcataatcgtcgtttaaataacaaaccgtccattcaggagaaatgaaatcagtaaattcaacatcaaaatcacatgtcaatgaatgaattgattcaatactgttaataagtattccaggacgtattaaagactttttacctttataaaatccagaaagactttcatcagtttcatatgaagacccccaatagtaattacgtccttctgccatgcgtttaagagcatttagtaattggtctggaacatcaacctgtctttggaactcttcaaacattgaattgaaatcactttgcattttcattcctacttactccaagtaataggggccgaagccccttatcattatttcagagaattaatatattcctgaacatcggcagaggtagtttcaaccccagaaatattaccattaaaggtttcaactcgggcgagagtatcttcaatatcaactttagttagcgctgcaatttcaactacatcatcagcagtactaattccaagggcatttgctgcacgagtttcacggatatattccaatttaactgcaagttcttggcgagcatcatccaattcaactactttcttggcgatttcaattcgcatttcagcataaccatcagctttagtagtcaactgttcagctgttcgacgatatagcaagccgagtttagcatgcattgttacatcttgaccttcagaaagaagcttgcgaatttcacgctcttttgattcggcctgtcgattcttttcgacaataagttcacgaatacgtttttcttcattaatagatttaacagaagcagtttttagatctttaatcttatcaagtagttttgctgccgcagcagtatactgttcttcaacagataaatttttagccatagcagaaccaagtttagtgcgaataaactcaacaattttcttcagcatgttcatagcatttcctttagttaattaagggttttataatccgtgggagtattatactctactcccaagagtttgtaaacttattcttcgtccaattcatcaataaatttatcgatactactattaatagactcatcgatgattaacaaagcatcatcatcatccataatattaatattttctaaagcatcaatataagcttgattgactatagaccatgccctttgaaaatatggggcttcatcatcaggactgaaccaacgtacaccttcaaagatacgtttggcataatctaacacccattgtacaggcatgttttgagaacgttcgttaaactctttaaagtccttagattcaaaaagctcttcaggataataatttctattacaaaaagctttactaaagttacgtttcataatgttctcctcaaagttataggctcataatatctcaatcatgagcctgtgtaaacttatttcatattattgaaatattcttctgcgatttcgtcgttatcatggtaaactttagaagacagtttaacataaccttctgccgtgaacatattaattacaacctttacagtataccactgaccatcttcattacccattactgcataagtttcaaacatcggatgatcaggaccgataactttaatatcattcactgtacgaccaaaatcttctgaaacacatttcataaagaagttgaacagttcgccgtaattatccatttcattctccaagttgttttctgtatcagtagttgatagttgtatagtaccatggaaggacaaggatgtaaaccgttttgtgaaaaaaaatttttaaaaagttttggggaattctagggcagggaggggaaatcaaaggataggataatatattataaagggtagaaactaaatgatgtctagagaggcctggaaaggcctagataccaaaaagccccaacctttcggctagggctaagaatgttatttgatttgtttagcagaccaaatgcggtctttaataattttttgaatgtcttcaacatactcaagagagtgagcatgtgggttatctttgaaactataagcacgagctagtttttggccttcagttttgattactaaaagctctttaaggatagcttcatatttggagataattcctttaacaatatttttctcttgtgctgctttagggtcagccttaggagcaggtttacctgaagcctttgcaaaagcagctccagtagcaactaaacttttccaagccatactaactgcattccctgtaaatccttcggctttcatatcacgagcaaattggaatcgtgattcatcggaagcatctttataggaatatttacccgcggcaatggcagcttttgcgacagcttgaatttcggtgctagatgcttcatttaacaccgcttcatttaaaaattgagcatatgatttcatcttatttcctgttttaattcgtggttttaatatacttatttatactaaaaagccccaacctttcggctggggctaagccttgcggcaaccttgtcggggttccacctgctaaggcaagtgtttgtacgaaacgccgggattcgaacccggttattaagcagttgacgctactcaatatttttaaaaggccatatctcgaccatatccgaacgttccgtcaaaaacgctactcggcttacggcaaagatatttcctcgaatcgataattcggtgcgccgtttctgctgtgatataaggggacatcaacaaaacataaagatttattaatgccagtccttaaacagggaacatcagtccgacgacttaccggtagcgacccggcttcttattctgacatataataaagttgctcacgtcgtctacgccataaattaattgcttcatgagcacattcagcgttcaggataggacgacaataatataacgactcacgtttctggaaccgatgctgcaatgggatttcatttaaaaggtctttacggtcaaagtattcgtaaccatctaaacctactgaacgatttttaataaacttccaatggccgaattcattctgaatataaatgtagtcagcgtgttggtatagtgccataatctcacggtcagaaatagctgtttcatgttcgttaaaataaaacgttaaatcatgtactactaagtaaacgttgcctttcatattttcctcacttataattggtcgaggcagtagggatcgaacctacgacctaggacttagaaggtccttgctcttccttctgagctatgccccgtaattggggtgaccgatgggagtcgaacccatgactacgagaatcacaatctcgagttctaccaactgaactacggccacattaatacctactccaacaatcaagatgtcttcacacgaaattaagagaagagtgatcagttcaacccttataatcgcgtcaagtagatattaatgtgacagttgtcacaaatttggcggacgtgataggattcgaacctataaccaatcgcttaacaggcgatcgctctgccattgagctacacatccaaattggtggggagtgatggagtcgaaccacccgagtcgcaatgacaatgaatttacagtccacaccgctacctctacgggataactccccttaatttggtggccctgggtggaattgaaccaccatctggcgattatgagtcgcttgcttgaaccttcaccttccagctacagggccttggtgctgattgacggaatcgaaccgccgaccttctcattacaagtgagttgctctacctactgagctaaatcagcaaaaactggcggaggcgataggatttgaacctatgagtcgccggagcgactgccggttttcaagaccggtgcattaaaccactctgccacgcctccagtctccatacaaggatttgaaccttggacctcctgatcccaaatcaggcgctctaccaaactgaggtacacggagtaatttaaattggaacggataatggaaatcgaacccacatcatcaaattgggaggttgaaggtaataccattatacgatatccgcaatttggtgcgagaagtgggactcgaacccaaatagaaatacagcattttaagtgctgtgcctttaccaatttgaccattctcgcgctgggaataaaggactcgaacctttgcatctggcactcaaaatccaatgccttaccaacttggctaattcccaattattaacaaaggctctcaaacaagaacccttgatgatagagggtattaatcagtgcggtatgagttaataataacaaataattcttaaagcatatttaccatttatgataatacatatttacgatacattcaagacccaaaggattcttgaaaatatcatattcaagaggacctttttctgtttcgataaagaaatcaaaatttactgtattaaatttacggtcttccttcactaatttaacttgagaagatgaacggtcaatgtaaaccttttcaacttcaaaatatgttaaaatgccataatcatcaatcaaggctttagccgcgtcttgatcatatttatatccattttcaatggatgatactttcgcgtaaagaatcattatcaaccttcatcaacaatagtatgcgtattggcatttacaatttgccaccaatcaaagcgattggaaccataatctggtttgttttcattttctttgataatatcacggagttcatcttcggtagcggctttcgcgattaaatcagcatatccaccacgaggataataattatcacctgcaaaaagtaaaaagtttggtttaatgttattgaactcttcaagagtaataacctttcctgacggttgaacaatctctacatatttatatcccaatttttgagcagcatctactgcttcaagcaaagtatcatgagcccatccaatttgacaacctggcttttcagatggattagcctgataatccgcatacactttgtacattctattcacctttagaaattttatccataacgatagcaattaaaccaattaaaaatgctactacaagtgaaaacacattttctgctgtagtcaataatccgcatataaatccaacaaacattgaaaaactaaaagcagaagcagaaattgcaatagcaacatttcgaattaattcacaacgtttcattttattctcctcggtagttgatagggtaatagtatcactaccctatctaaaagtaaacttattttttacgaaaaattgatttattttctgctgcccatttttcaataactgcagcaggaccagtaacaacaattttatcaccgtaatcttctgcggcgagttgaccgaaattatctaatgcatcacgaagaactccatgaggcatttcacccattttatctttcttgccggtgtaaataaactcaacttttacatcagaagattcagcgataaactctttgaaagttttcattttgatttccatttggttttgttttgatagagtaatagtatcactactaaaaccctgtgtaaacaactttgtgaaattattttaaatcttctaatcgtttcttcatcttagaaccatttttagcaatttctcctgcatctgagcataatgctaaaagtgctttaactttagtttggtctcctttaaaagatgaaggatcgactgcagcagcaagttctttaatacgagagaaaagacgctcagcttcagctaaagccattccaagctttacttccataccgtgggaagattcagtgatagtagtttttgtagcaaactctttgaaagttttcattttattttcctaattaattttgatgaggtaatagtatcactacctcatcagtatgtaaacaactttgtgaaattattttaaatcatctgcccaatcgagtttaagaggctctttgtattcacgatctaatacgaccggaatttgtacatcaccgctaaatgataagggcccaacattataagacaatgttatatgcggtgtgtaatcatcaaaatcatgtgtagcacctagtgcccgcgcatacatgtgtcgacagcgcagatattcagaatctagcacaagtacaagagtcgatccatcttgtgttttccatacttctaaatgtccagaagaagctacttcaaaacttccgcttgatggaacatatggaacatttactcttgaataacatatggtcgaatgaattttttctctaggaactggattaggaacacgtaaagagcgctggagttcttccagcgcatcaagtgttaattctgaaaacttagctgctacataaagacccgttgaaaagtctttaaattccattattcttcatcttttgcttcatcagtagattcagcagtaagattcttgacagcttcaacgatttcttcaactttgatagtatcgccagtgatacctactgcacgagcgatttcagccaaagttccttgcagaattttggattcttccatcagacgagccgcctggtcctgcgtatcaagaatacgagacttcagagttacgatttcagcagacagtttttgttcaatagtttgttcagacattatagtacctttagtgtatttttaattttagaaaaaagttcttcaagagaaccatcgtttgtaattactaaatcgccatcatgaattggcaatccagcttctgtaatatgtgtatcattggatttttgaccaggacgaactacatgaattactgtagcacccatcgccctagccgcatccatttcatgatcttgacgagtatcaggaacgatataataatcataacctgagttaaatttatcaagataatctaaagcaaataattttacccaatacatgcggtcgaagttattaacaatcaaatccgtacctagggcttgcatcagacgacggactgaccattgatcttcaatattatttataacgtcagcaatcttgttaaatgctacgaaattaactgcgtcatcaaaaacaaacacacctttaattgggcttttactattaagatagcaaaatgcttgttccataatcgtaattacttctaatttagtcagatttaaattagtttcacgatcatagtcaattccttcaaactctttacgagttaaacaaggatagtcagtgtttgctgcaaatacaccccatgcataagccaatgcatccttaataggaccagcaagttgatatttaactgcagaataattattcataataaaatctgcagtagtatcttttccactacgctttacaccacttaaaaagattagtttcatatgtttctcctcaaatttagttaagattataacacatgaaactgaagcattaaacttctgctataatttttccatctttttctacttgaaaatacgtataaggaatcgttgctgtgcatactaaggctgggtctgaatcttctgtgtagctaaattctacttcagacaggtcagaaacccagggcttataaaaatttattgacatcacgatttcagttttactattatctaaaatgtaaagcgtaatgtattcaggacctgttttttgggcagtattttcgcctgtaagatagttactagttcctagcatccattcatacattcctatccacgacttaagctcttcatcaactataaatctcacgatgagtgggtcgtactcaaatgtaacacctggacgttgtgctcggcctagtccaaacggcccagtcacggtatcagtaacaggtatcctaattcccggaataggaactgactgagcatttaaagtaaaagcggatgtagtattactatgcggtattgatactacaaagttagttgtatttgcttggttaaaaatttgttgtagtgcttgcgacatatattcctcataatgcttcataaatgttggtggtataatgggtctaagtcccttccattcaattccaattagaacaaacaatagaaaagaatggaagataatagaattagatatttgaccagactttgtttgcagagaaacgttttccttttgaaacgaactgctgaagtggcattaacacaacgttcgcccagtctttcggggcgatttcaacgaggctacccataatattaccaggtatatatgccttaatcatttggtctgcacccctaaatcctttcacttgactccaatcaatttttaatttcgttttattagtaatagtaggtgtatttgaatattgctttaaaagctcttctagaaattgctgacgagctttaggtggaatatagtgcaagttcaatccgtacattaaattatgtttacctaaaccaaggtaaattatcaaaggaaatttatcccaataaggaagagtttccttgtgtttagcatcataagcaaaagcatatattcgtcccggctgcgggcgaacaactttatgtccttttacttgcttaatagtttcagcaaaccactttctggttttattattaattgctgcaccttcattacgaattttatcacgcaatgtttgcctgaatgaatttatcataagcagttgtctttcttgcttattgagtttattcattggttttgattcaagcttttgaatcttttcagccgttttaattcctgaagcatattttgacattgccgaagtaaacgtagagtatttgattcctctttcttcagcaaattgctttcctgtcattccttttgctttggcctttctgtattcaagacctatctgaatccatttcttttcgtttaatgattgcttaacctttggaacttggggagtgctttcattaattatttgaaaaatagccattatgcccccttaaagccaagagctcttaatccatcttctgttagaattctaaattttattccacgcttttcagctaaagcttgcgctgctttccatttatcagtattaacggaatatgtataaatttcattcataaatcttttcttcgctgcggttgttagatgtgccggtttaactggtggttgtgtttcttttttaggttttatttcaataaaaaattcttgtccagaagaatctttcatccaaatatccatgaagtatctacgttttttcccttctgcattacaaaaataaggaattactgctgtttcactaccccatgcaataatttctggatttttatctaaccattcaaaaaagaatttttcccaatttgatctatacgtaatttttttagggtcacctctatattttgatatatttttaggaacccattttccagaatatgccattggattctccttataaatagataatatatttataaacaggagggcccatgctctttacattttttgatccgattgaatatgcggccaaaacggtgaataaaaacgcgccgactattcctatgacagatatttttagaaactataaagactatttcaaacgtgctcttgcgggataccgcttacgtacttattatattaaaggttcaccacgccctgaagaattagcaaatgctatatatggaaatccgcagttgtattgggttttattgatgtgtaatgataattatgatccgtattatggatggattacttcgcaagaagctgcttatcaagcatctatacaaaaatacaaaaacgtaggtggagaccaaatagtatatcatgtgaatgagaacggtgaaaaattttataatttaatatcatatgatgataatccatatgtttggtatgacaaaggcgataaagctagaaaatatcctcaatatgaaggagcacttgctgcggtagatacgtatgaagctgctgttcttgaaaatgaaaaacttcgtcaaataaaaataatagcaaaatcagacatcaattcatttatgaacgaccttatacgtataatggagaaatcttatggaaatgataagtaataaccttaattggtttgttggtgttgttgaagatagaatggacccattaaaattaggtcgtgttcgtgttcgtgtggttggtttgcatccacctcaaagagcccaaggcgatgtaatgggtattccaactgataaattaccatggatgtcagttattcaacctataacttctgcagcaatgtctggaattggaggctccgttactggtccggtagaaggaactagagtttatggtcattttttagacaaatggaaaactaacggaattgtccttggtacatatggcggaatagttcgcgaaaaacctaatagacttgaaggattttctgacccaactggacagtatcctagacgtctaggaaatgatactaacgtactaaaccaaggcggagaagtaggatatgattcgtcttctaacgttatccaagatagtaacttagacactgcaataaatcctgatgatagaccactatcagagattccaactgatgataatccaaatatgtcaatggctgaaatgcttcgccgtgatgaaggattaagactaaaagtttattgggataccgaaggatatccgacaattggaattggtcatcttatcatgaagcagccagttcgtgatatggctcaaattaataaagttttatcaaaacaagttggtcgtgaaattacaggaaatccaggttctattacaatggaagaagcgacgactttatttgagcgtgatttggctgatatgcaacgtgatattaaatcacattctaaagtaggaccagtctggcaagctgtcaaccgttctcgccaaatggcattagaaaatatggcatttcagatgggtgttggcggtgtagctaaatttaacacaatgttaactgctatgttagcaggagattgggaaaaagcatataaagccggtcgtgattcattgtggtatcaacaaacaaaaggccgtgcatcccgtgttaccatgattattcttacggggaatttggaatcatatggtgttgaagtgaaaactccggctaggtctttatcggcaatggctgcgactgtaactaaatcttctgaccctgctgaccctcctattccaaatgactcgagaattttattcaaagaaccagtttcttcatataaaggcgaatatccttatgtgcatacaatggaaactgaaagtggacatattcaggaatttgatgatacccctgggcaagaacgatatagattagttcatccaactggaacttatgaagaagtatcaccgtcagggagaagaacaagaaaaactgttgataatttgtatgatataaccaacgctgatggtaattttttggtagccggtgataaaaagactaacgtcggtggatcagaaatttattacaacatggataatcgtcttcaccaaatagatggaagcaatacgatatttgtgcgtggcgatgaaactaagacggttgaaggtaatggaactctcctagtcaaaggtaatgttactattgtagttgaaggtaatgctgacattacagttaaaggagatgctaccactttagttgaaggaaatcagactaatacagtaaatggaaatctttcttggaaagttgctgggacagttgattgggacgttggtggtgattggacagaaaaaatggcatctatgagttctatttcatctggtcaatacacaattgatggatcgaggattgacattggctaatatacttccaatgagcgctgatttaggagaatccatggaaggttcttctatcgacgtcacctttactgctcaattagaaacaggtgaaacgttagtatctataaatataactagttacgaagaaactcctggggttttagtagaagaaaatcgtttatatggaacgtatgaatctgtatttggatttggaaatgatgcgttgaaatatcgtttaggcgatgaatttaaaactgctgcttcatgggaagaccttccaactgattctaatactcagttatatttatggaaagctcctcaaaacctccagaagacattcacttacgaagtaacattaatatatgactaccaagaacaaagtgaatctggaggttctggcagtaattctaggtcatcttctgatactactgaaccaacgaatcctccagctccaataagaaaaactcttgttaaaaattacacaaaaactatagttggaaattggagtcgttgggctaataaattgagaagctatgtgtatgagaggccataaatgtcaggattaagttatgataagtgtgttactgccggccatgaagcatggcctccaacagttgtgaatgctacacaaagtaaagtattcactggaggaattgctgttctcgtagcaggtgatccaattacagaacatacagaaattaaaaagccatatgaaacacatggcggagtgacacaacctagaacttctaaggtatatgtcactggaaagaaagctgttcaaatggctgatccaatatcatgcggtgatactgtggctcaggcatcatctaaagtattcattaaataggatttaaaatggcaaatacccctgtaaattatcaattaacaagaacagcaaatgctattcccgagatattcgtcgggggtacatttgctgaaataaaacaaaacctcattgaatggcttaatggccaaaatgaatttttggattatgattttgaaggctcaagattaaacgttctgtgcgaccttttggcttataatacattgtacattcagcagtttggtaatgctgccttgtatgaaagctttatgcgtactgctaatttgcgtagttcagtagttcaagctgcacaagataatggatatttacctacttcaaaatcagctgctcaaactgaaattatgctaacttgtacagatgcattgaatagaaattacattactattcctcgtggtactcgctttttagcatatgcaaaagatacttccgttaatccttataactttgtatctaccgaagatgttattgctattcgcgataaaaataaccaatattttccgcgtttaaaattagcccaggggcgtatagtaagaactgaaatcatttatgataaattaacacctattatcatttatgacaaaaatatagatagaaaccaagttaaactgtacgttgatggagcagaatggattaactggacaagaaagtcaatggttcatgctggttctacatcaacaatttactacatgcgtgaaactattgatggaaatactgagttttattttggtgaaggtgagatttctgttaatgcggcagaaggagcattgactgctaattatattgggggtcttaaacctacccagaactctacgattgttattgagtacatcagtactaacggcgcagatgcgaatggcgcagtcggattttcatatgcagatacattgacaaatataactgtcatcaacattaatgaaaatccaaacgatgacccagattttgttggggcagatggcggcggcgatccagaagatattgaacgtattcgcgaattgggtactattaaacgcgaaacccagcaacgctgcgtaactgcgactgactatgatacattcgtttcagagagatttggttctattattcaagcagttcagacgttcactgattctactaaacctggttatgcatttattgctgctaaacctaaatcagggctatatttaactactgtacagcgcgaagatattaaaaattatctcaaagactataatttagctcctattacgccatcaattatttctcctaattatctttttattaagactaatttaaaagtcacatatgctttaaataagctacaagaatccgaacagtggctcgaaggtcaaataattgataaaattgatcgttattataccgaagacgtagaaatttttaactcatctttcgctaaatctaagatgttgacatatgtagatgatgcagatcactctatcattggctcatcagcgacaattcaaattgttcgtgaagtacaaaacttctataaaacgcctgaagcaggtattaaatacaataatcaaataaaagatcgttctatggaatctaatacgttttcatttaattctggacgaaaggttgtaaatcctgatactggtttagaagaagatgtattatatgacgttcgtatagtatcaacagaccgagattctaaaggaattggtaaagttattattggtccatttgcttctggcgatgttacagaaaatgaaaacattcagccgtatacaggcaacgattttaacaaattagcaaattctgatggacgcgacaaatactatgttatcggtgaaataaattatccagctgatgtgatttattggaatatcgctaaaattaatttaacatctgaaaaatttgaagttcagaccatcgaattatattctgacccaaccgatgatgttatttttactcgcgacggttcactgattgtatttgaaaatgacttacgtccacaatacttaactatcgatttggagcctatatcacaatgacagtaaaagcaccttcagtcactagtctcagaatttccaagttatccgcaaatcaggtgcaagtacgctgggatgacgttggtgctaatttctactattttgtagaaatcgctgagacaaaaacaaactcgggggaaaatctcccgagtaatcaatacagatggattaacttaggatatactgcaaataacagcttcttttttgatgatgctgacccattgacatcatacattatcagagtagctacagctgcacaagattttgagcagtctgattggatttataccgaagagtttgaaacttttgctacaaatgcttatacatttcaaaacatgattgaaatgcaattagctaataaattcattcaggaaaaatttactcttaataattctgattatgttaattttaataatgacactataatggctgcattgatgaatgaatcatttcaattcagcccatcatatgttgacgtttcatcaataagtaattttattattggtgaaaatgaatatcatgaaatacaaggttctattcagcaagtatgtaaggatattaaccgagtttatttgatggaatcagaagggattttatacctttttgagcgttatcaacctgtagttaaagtatccaatgataaaggacaaacttggaaagctgtaaagctcttcaatgaccgcgtaggatatcctttatctaagacagtatattaccaatctgcgaacacaacatacgttctaggatacgacaagattttctatggccgcaaatcgactgatgttagatggtcagctgacgatgtcagatttagttctcaggatataacattcgctaaacttggcgaccaattacatttaggatttgatgtagaaatttttgccacttacgcgactttaccagcgaatgtatatcgcattgcagaagctattacttgcaccgatgattacatttacgttgttgccagagacaaagttagatacataaaaacgagtaatgcacctatagattctgatccattatctccaacatattcggaaaggctttttgaacctgatacaatgactataaccggaaatcctaaagcagtatgctataaaatggattctattggtgataaagtttttgctcttattatcggtgaagttgaaacattaaatgctaatcctagaacatcaaaaataattgattctgctgataaaggaatatatgttttaaatcacgacacaaaaacgtggaaaagagtttttggcaacactgaagaagaaagaagacgtattcaaccggggtatgcgaatatgtcaactgatggtaaattagtttctctatcatcgagtaattttaaatttttaagtgataatgttgttaatgaccctgaaactgcagcaaaatatcagttaatcggtgctgttaaatatgaatttcctcgtgaatggttagctgataagcattatcatatgatggcatttatagcagatgaaaagtctgattgggaaacttttacgcctcagccgatgaaatactacgcagaaccgttctttaactggtctaaaaaatctaacacacgttgttggataaacaactccgatagggttgtagtagtttatgctgatttaaaatacactaaagttatagaaaatattccggaaacatcaccagatagattagttcatgaatactgggatgatggcgattgtactatagtaatgccaaatgttaaattcactggatttaaaaaatatgcatctgggatgcttttctataaagcctctggtgaaataatttcttactatgattttaactatcgtgttagagacactgtcgaaattatttggaagccaactgaagtatttttaaaagcatttttacaaaaccaagagcatgaaactccttggtcgcccgaagaagagcgtggattagctgaccctgatttaagaccattgattggcacaatgatgcctgattcttatttgttgcaggattcgaattttgaggcattttgcgaagcatatattcagtatctttctgatggatatggaactcagtataacaatttacgaaatttaattcgtaacaaatatccacgagaagagcatgcatgggaatatttgtggtcagagatatataaaagaaacatttatttaaatgctgacaaacgtgatgctgttacaagatttttcgaatcacgtagctatgatttttattctactaaaggaattgaagcatcatacaaatttctttttaaagttctttataatgaagaagttgaaattgaaattgaatctggggctggtactgaatatgatataatcgttcaatctgattctttgactgaagacttagtaggacaaacgatttatacagctacaggaagatgtaatgttacttatatagaaagaagctattctaatggtaaattgcaatggaccgtaactattcataatcttttgggaagattgattgccggtcaagaagttaaagcagaaagacttcctagttttgaaggcgaaattattcgtggggttaaaggaaaggatttgcttcaaaataatatagactatattaatagaagtcgatcatattatgtaatgaaaattaaatccaatttaccttcttcccgctggaaatctgacgttattcgttttgttcatccagtaggatttggatttatagcaattacccttttaacaatgtttattaatgttggtttaactcttaaacatacagagactataattaataaatacaaaaactacaaatgggattctggattgcctactgaatatgctgatagagtagctaaattaactccaaccggtgaaattgagcatgattcggtaacaggcgaagcaatttatgagcctggcccaatggctggcgtagaatatcctcttcctgatgactataatgctgaaaataacaattcaatatttcaaggtcaattgccgtctgaacgacgtaaattaatgagtcctttattcgatgcatctggaacaacatttgcacaatttagggatttagttaataaacgtctaaaagataatataggaaatccaagagaccctgaaaatccaacacaggttaaaatagatgaatgattcaagtgttatctatcgtgcgatagttacttcaaaatttagaacagaaaaaatgttgaatttttataattcaattggaagtggtccggataaaaacactatctttatcacatttggaagatcagaaccgtggtcatcaaatgaaaatgaggtgggctttgctccaccttatcctaccgattccgtattaggtgtaactgacatgtggactcatatgatgggaaccgtgaaggttcttccatctatgcttgatgcagttattcctcgtcgagattggggagatactagatatccggatccatatacatttagaattaacgatattgtagtgtgtaactcagctccttacaatgctactgaatctggcgcaggctggttagtatatcgttgtttagatgttcctgataccggaatgtgttcaatcgcatctttaactgataaggatgaatgccttaagttaggtggaaaatggactccttctgctaggtcaatgactccgcctgaaggccgaggagatgctgaaggaacaattgaacctggggacggatatgtttgggaatatctatttgagattccgcctgatgtatctataaatagatgtacgaatgaatacatcgtggttccttggcctgaggaattaaaagaagacccgactagatggggatatgaagataatctcacttggcaacaagatgattttggattaatttaccgtgttaaggcaaatactatccgttttaaagcatatttagattcagtttattttcctgaagctgcattgccaggaaataaaggatttagacaaatatcaataatcacgaatcctcttgaagctaaagctcatccaaatgacccaaacgttaaagctgaaaaggattattatgatccggaagatttaatgaggcattcgggcgaaatgatttatatggaaaataggccacctattatcatggcaatggatcaaacagaagaaatcaatattctgtttacattttaacttaagggagcccatgggctccctttttctttataaatactataaactcataaggaaaccgctatgttcattcaagaaccaaagaaattgattgataccggcgaaattggtaacgcttctactggtgatatcttattcgacggtggtaataaaattaatagtgattttaacgcaatttataatgcgtttggcgatcaacgtaaaatggcagtagcaaatggcaccggagctgatggtcaaattatccatgctactggatattatcaaaaacactctattgcagagtatgcaactccagtaaaagttggcactaggcatgatattgatacctctactgtaggtgttaaagttatcattgaaagaggcgaactcggcgattgtgttgaattcattaactctaatggatcaatatcagttactaatcctttgacaattcaagctattgattcaattaaaggtgtttcaggtaatttagtagtaactagtccatatagtaaagtaactttacgctgtatttcatctgataattctacatcggtttggaattattctattgaaagtatgtttggacaaaaggaatcaccagctgaaggtacatggaatatttctacatctggatcagttgacattccattatttcatcgcactgaatacaatatggctaaattactagttacatgccaatcgatagatggaagaaaaattaaaacagcagaaataaatattcttgtggatactgttaattcagaggtcatttcttctgaatatgctgtcatgcgagttgggaatgaaaccgaagaagacgaaatcgctaatattgcatttagtattaaagaaaattatgtaacggcgactataagttcttcaactgtcggtatgagagcagcagttaaagttatcgctacgcagaaaatcggggtggctcaataatgaaacaaaatattaatatcggtaatgttgtagatgatggtaccggtgactacctgcgtaaaggtggtataaaaataaatgaaaactttgatgagctttattatgaactcggtgatggtgatgttccatattcagccggtgcctggaaaacttataatgcttcatcaggacaaacattaaaagctgaatggggaaaatcatacgctattaatacatcttctggaagagtgactataaatcttccaaagggtacagttaatgattacaacaaggtaattagagccagagacgtatttgctacatggaacgttaatccagttacactggtagctgcttccggtgatacgattaaagggtctgcagtaccagttgaaattaatgttcaattcagcgatttagaactagtgtattgtgccccaggacgttgggaatatgtcaaaaataaacaaattgacaaaattaccagttcagacattagtaatgtagctcgtaaagaatttttagtcgaagttcaaggacaaacagactttttagatgttttccgtggaaccagttataatgtaaataacatcagagtaaaacatcgtggtaacgaattatattatggcgatgtatttagcgaaaacagtgattttggctctccgggcgaaaatgaaggagaactagttcctcttgatggatttaatattcgattaagacagccttgtaatattggtgatactgttcaaattgaaacatttatggatggcgtatcacagtggagaagttcatatacaagacgtcaaattagagtgttagattcaaaattaacgtcaaagacttctttagaaggaagcatttacgttactgatttatcaacaatgaaatcaattccgttttcagcttttggattaattccaggtgaacctattaatcctaattctctcgaggtccgttttaatggaattttacaagaattggctggaacagttggaatgccattatttcattgtgttggtgccgattcagacgatgaagtagaatgctctgttttaggtggaacttgggaacagtctcataccgactattcagttgaaactgatgaaaacggcataccggaaattttacattttgatagagtatttgagcatggtgacattatcaatatcacctggtttaataatgatttgggtacattattaacaaaagatgagattattgatgaaactgataatctctatgtatcgcaaggaccgggagtagatatttctggtgatgtaaatttaacagacttcgataaaattggttggccaaatgtagaagcagttcaatcttatcaacgcgaatttaatgctgtttcaaatattttcgatacgatttatcctattggaactatatatgaaaacgctgttaatccaaacaaccctgttacatatatgggattcggctcatggaaattatttgggcaaggaaaagttttagttggatggaatgaagatatttcggatccgaattttgctctaaataacaacgatttagattctggcggaaatccttcgcatactgcaggtggaacaggtggttctacttctgttacattggaaaatgctaatcttcctgcaactgaaacagatgaagaagttctaatagttgatgaaaatggatcagtcattgttggtggatgtcaatacgatccagatgaatctggtccagtttacacgaaataccgtgaagctaaagcatctactaactctactcacactccgccaacatcaataactaacattcaaccatatattacagtttatcgttggataaggattgcataatgagtttacttaataataaagcgggagttatttcccgcttagccgattttcttggttttagacctaaaactggcgacatcgatgtaatgaatcgtcaatcggttgggtcagtgacaatttctcaattagcgaaaggattttatgaaccaaacgtagaatcagctattaatgatgttcataatttttctataaaagacgttggtacaattattactaataaaactggtgtttctcctgagggtgtttctcaaactgattattgggcattttcaggaactgtgacagatgattcgcttcctcctggttctcctgttactgtattagtatttggtcttccagtttcagcaacaaccggaatgacagctatcgagtttgttgcaaaagttcgcgttgcgctacaagaagctattgcgtcatttactgctatcaactcatataaagaccatccaacagatggtagtaaattagaagttacttatttagataatcaaaaacatgtattaagcacatattctacatatggaataactatttcgcaggaaattatttctgagtctaaacctggctacggtacatggaatttattaggcgcacaaactgtaactttagataatcagcagactcctacagtattttatcattttgagagaacagcatgagtaataatacatatcaacacgtttctaatgaatctcgttatgtaaaatttgatccaactggtacaaattttccggcagagattactgatgttcaggctgctatagcagccatttctcctgctggcgtaaatggagttcctgatgcatcgtcaacaacaaagggaattttatttcttgccactgaacaggaagttatagatggaactaataataccaaagcagttacaccagcaacgctggcaacaagattatcttatccaaacgcaactgaaactgtttatggattaacaagatattcaaccaatgatgaagccattgccggagttaataatgaatcttctataactccagctaaatttactgttgctcttaataatgcgtttgaaactcgtgtttcaactgaatcctcgaatggtgttattaaaatttcatctctaccgcaagcattagctggtgcagatgatactactgcaatgactccgttaaaaactcaacagttagctattaaactaattgcgcaaattgctccttctgaaaccacagctaccgaatcggaccaaggtgttgttcaattagcaacagtagcgcaggttcgccagggaactttaagagaaggctatgcaatttctccttatacgtttatgaattcatctgctactgaagaatataaaggcgtaattaaattaggaacacagtcagaagttaactcgaataatgcttctgttgctgttactggtgcaactcttaatggtcgtggttctacaacgtcaatgagaggcgtagttaaattaactacaaccgccggctcacagagtggaggtgatgcttcatcagcactagcttggaatgctgatgttatccaccaaagaggtggtcaaactattaatggaacacttcgcattaataatacgctcacgatagcttcaggtggagcaaatattaccggaacagttaacatgaccggtggttatattcaaggtaagcgtgtcgtaacacaaaatgaaattgatagaactattcctgtcggagctattatgatgtgggccgctgatagtcttcctagtgatgcttggcgtttttgccacggtggaactgtttcagcgtcagattgcccattatatgcttctagaattggaacaagatatggcggaagctcatcaaatcctggattgcctgacatgcgtggtctttttgttcgtggctctggtcgtggctctcacttaacaaatccaaatgttaatggtaatgaccaatttggtaaacctagattaggtgtaggttgtactggtggatatgttggtgaagtacagaaacaacagatgtcttatcataaacatgctggtggatttggtgagcatgatgattctggggcattcggtaatacccgtagatcaaattttgttggtacacgtaaaggacttgactgggataaccgttcatacttcaccaatgatggatatgaaattgacccggcatcacaacgaaattccaaatatacattaaatcgtcctgaattaattggaaatgaaacacgtccatggaacatttctttaaactacataattaaggtaaaagaatgacagatattgtactgaatgacttaccattcgttgacggccctcctgcagagggccagagccgcatttcctggattaaaaacggcgaagaaattttaggagctgatacacagtatggaagtgaaggttcaatgaatagacctacagtttctgtactaagaaatgttgaagttcttgataaaaacattggaatacttaaaacatctttagaaaccgcaaatagtgatattaaaaccatccagggcatcttagatgtatctggtgatatagaagctttagcacaaataagtatcaataaaaaggatatttctgaccttaaaacgctaaccagtgaacatacagaaatattaaatggaactaatagtacggttgacagcattcttgctgatattggtccatttaactccgaggccaactctgtatacagaacgatcagaaatgatttactgtggataaagcgtgaacttggacaatacaccggtcaagatattaatggtcttcctgttgtaggaaatcctagtagtggaatgaagcatcgcattattaataatactgatgtcattacttcacagggaatacgtttaagtgaattagaaacaaaatttattgaatctgatgtaggttctttgaccattgaagttggtaatcttcgcgaagagcttggaccgaaaccaccgtctttttcacaaaacatttacagccgcttaaatgaaattgacactaaacagacaacagttgagtctgacattagtgctattaagacctcaataggatatccaggaaataattcgattattacgagtgttaatacaaacactgataatattgcatctattaatttagagctaaatcaaagtggaggtattaaacagcgtttaaccgttattgaaacttctattggttcagatgatattccttcgagtattaaaggccaaatcaaagataatacaacttcaatcgaatctttaaatggaatcgtcggtgaaaacacttcatctggtttaagagcgaatgtttcgtggttaaaccaaattgttggaactgattctagcggtggacaaccttctcctcctgggtctcttttaaaccgagtttctacaattgaaacttctgtttcaggcttgaataacgatgttcaaaacctacaagtagagattggtaataacagcacaggaattaaaggacaagttgtagcgttaaatactttagtaaatggaactaatccaaacggttcaactgttgaagaacgcggattaaccaattcaataaaagctaacgaaactaacattgcatcagttacacaagaagtgaatacagctaaaggcaatatatcttctttacaagacgatgttcaagctctccaagaagccggttatattcctgaagctccaaaagatggccaagcttacgttcgtaaagacggcaaatgggtattactttctacctttttatcaccagcataacatggggccgcaaggccccaaaggattttaaatgtcaggatataattctcagaatccaaaggaactcaaagatgtcattctaagacgtttaggggctccaattattaatgttgagttaacacccgatcaaatttacgattgtatccagcgtgccctagaattatacggtgaataccattttgatggacttaacaaaggttttcacgtattttacgtaggggacgatgaagaaaagtataaaactggagtcttcgatttaagaggttctaacgtatttgcagtaacacgcattttacgcacaaatattgggtcaataacgtcaatggatggaaacgctacatatccgtggtttactgactttcttttaggaatggctggtattaatggcggaatgggaacgtcttgtaatagattttatggaccaaatgcctttggtgccgatttggggtattttactcaacttaccagttatatgggaatgatgcaagatatgctctctcctattccagacttttggtttaattcagcaaatgaacaactcaaagtcatgggaaacttccaaaaatatgatttaattatcatagaaagctggactaaatcatacattgatactaataaaatggttggaaatacagtaggatatggaacagtcggtccacaagatagctggtcattatctgaacgttataataacccagaccacaatttagtaggtcgtgttgttggtcaagacccaaatgttaagcaaggtgcttacaataatcgttgggtgaaagactatgcaacagctttagctaaagaattgaatggtcaaattttagcacgccaccaaggtatgatgcttcctggcggtgttacgattgatggacaacgcttaatagaagaagctcgattagaaaaagaagcactgcgcgaagaattatacttacttgatcctccatttggaattttggtaggttaatatggctacttatgataaaaatctttttgctaaattggaaaaccgcacaggttattctcagaccaatgaaactgaaatattaaatccttatgtaaatttcaatcattataaaaacagccaaatattagctgatgtattagtggctgaaagcattcaaatgcgaggtgtagaatgctattatgttccaagagagtatgtttcccctgatttggtattcggcgaagacttaaaaaataaatttactaaagcttggaaatttgctgcgtatttaaattcatttgaaggatatgaaggagctaaatcgttctttagtaactttggtatgcaagtacaagacgaagtgactttatctattaacccaaatttatttaagcatcaagttaatggaaaagaaccgaaagaaggcgatttgatatattttcctatggataacagcttatttgaaatcaactgggttgaaccatatgacccattttatcaattaggccaaaacgctattcgtaaaattacagcaggtaaattcatttattctggagaagaaattaatccagttctacagaaaaatgaaggaattaatattccagaatttagtgaattagaactaaatcctgttcgcaatcttaacggtattcatgatattaatattgatcagtatgctgaagtagatcaaattaattctgaagctaaagaatatgttgaaccttatgttgttgtcaataacagaggcaaatcttttgaatctagcccatttgataatgatttcatggattaataaatattataaactaattaaagcccagattaggagaaatcatgtttggttatttttataattcgtcttttagacgatatgctaccttgatgggcgatttgttttcaaatatccaaatcaaacgtcagttagaatctggtgataagtttatacgtgttcctattacgtatgcatcaaaggaacacttcatgatgaaattgaataaatggacatcgataaattcacaagaagatgtagctaaagttgaaactattctacctcgtataaatttacatttagttgattttagctataatgctccatttaaaacaaacattttaaatcagaatttactgcaaaaaggtgcaacttccgtagtatcgcagtataatccatctcctattaaaatgatttatgaattgagtatctttactcgctacgaagatgatatgtttcaaatagttgaacagattcttccatattttcaacctcattttaatacaactatgtacgagcagtttggaaatgatattccatttaaaagggatattaaaattgtactgatgtctgctgctatagacgaagctatagatggggataatttatctcgtcgtagaattgaatggtcattaacatttgaagtaaacggatggatgtatcctccagtagatgatgcagaaggattaattcgtactacttatacagattttcatgctaatacaagagatttgcctgatggcgaaggcgtttttgaatctgttgataatgaagttgttcctcgagatattgacccagaagactgggatggaacagtaaaacaaactttcactagtaatgtaaatagaccaacaccgccagaacctcctggcccaagaacatagaggttattatggaaggtcttgatataaacaaacttttagatatttctgacctccccggaattgacggggaggaaattaaagtatatgaacctctgcaattagtagaagttaaaagcaatccacaaaaccgtactccagatttagaagatgattacggagtagttcgtcgaaatatgcattttcaacaacaaatgctaatggacgcggccaagatttttcttgagacagcaaagaatgctgattctcctcgtcacatggaagtatttgcaactcttatggggcaaatgactacgacgaacagagaaatactgaagcttcataaagatatgaaagacattacatctgagcaggttggcaccaaaggagctgttcctacaggtcaaatgaatattcagaatgcgacagtattcatgggttcaccaacagaattaatggacgaaattggtgatgcttacgaggctcaagaagctcgtgagaaggtgataaatggaacaaccgattaatgcattaaatgatttccatccgttaaatgaagctggaaaaattttaataaaacacccgagcttagcggaaagaaaagatgaagatggaattcattggataaaatcgcagtgggatggaaaatggtatcctgaaaaattcagtgattatcttcgtctacacaaaatagtaaaaattccaaataattctgataagcctgaattatttcaaacttataaagataagaataataaaagatctcggtatatgggtcttcctaacttgaaacgagctaatattaaaacacagtggactcgtgaaatggttgaggaatggaaaaaatgccgagacgatattgtttattttgcagaaacatactgcgccattacacatattgactatggtgtcataaaggttcaattacgtgactatcagcgtgatatgctcaaaataatgtcatctaaacgtatgactgtttgtaatttatcacgccagcttggtaaaacaactgtagtagctatttttcttgcacactttgtatgttttaacaaggataaagctgtaggtattcttgcgcacaaaggctcaatgtctgcggaagttttagatcgtactaaacaagcaattgaactgcttcctgactttttgcagccaggaattgttgaatggaataaagggtctattgaactagataatggttcttcaattggcgcttatgcttcctctcctgatgcagttcgtggtaactcgttcgcaatgatttacattgacgaatgcgcatttattccaaacttccatgattcctggcttgctattcaaccagtaatttcatctggtcgtcgttcgaaaattattattactacgactcctaatggattaaatcatttttatgatatttggactgcagccgttgaaggtaaatctggatttgaaccatatactgctatttggaattcagttaaagaacgtctttataacgatgaagatatttttgacgatggatggcaatggagcatacaaaccattaatggttctactttagctcaatttcgtcaagaacacaccgcagcgtttgaagggacttctggtacattaatttcaggaatgaaattagctgttatggatttcattgaagtaactccagatgatcatggttttcatcgatttaaaagccctgaaccagatagaaaatatatcgcaactctagactgctcagaaggtcgtgggcaagattaccacgctttacatattattgatgttaccgatgatgtgtgggagcaggttggtgttttacactcaaacactatttctcatttaattctacctgacatcgttatgcgttatttagtagaatacaatgaatgcccagtttatattgaattaaatagtactggtgtgtcagttgcgaaatcactttatatggatttagaatacgaaggtgttatctgcgattcatatactgatttaggaatgaagcaaactaaacgaacgaaagcagtaggatgctctacattaaaagaccttattgaaaaagataagcttattattcatcaccgtgcaactattcaagagtttagaacgtttagtgaaaaaggcgtgtcttgggcggctgaagaaggttatcacgacgatttagtaatgtctttagtaatttttggatggttatcaacacaatcaaaatttattgattatgctgacaaagatgacatgcgactagcatctgaagtgttttcaaaagagcttcaagatatgggtgatgaatacgctccagtcatatttgttgattcggttcattctgctgagtatgttccagtatctcaaggtatgtcaatggtataaatatattaaagcatattaaagaggattaaaaatgactttattatctccgggcattgagctcaaagaaactacggttcaaagcaccgtggttaataactctactggtacagcagctttggccggtaaattccagtggggtcctgcttttcagattaaacaggttacaaatgaagtagatttagttaatacttttggtcaaccaacagctgaaactgctgactattttatgtctgcgatgaatttcttgcagtacggaaatgacttacgagtagttcgtgctgttgatagagataccgctaaaaactcatctccgattgctggtaatattgaatacacaatttctaccccaggtagtaactatgcagttggagataaaatcacggtcaaatatgtttcagatgatattgaaactgaaggtaaaattactgaagtagacgcagatggaaaaatcaagaaaattaatattcctactgcaaaaattatcgctaaagcgaaagaagtcggtgaatatccaacactaggttctaactggactgcggaaatttcttcatcttcctctggtttagctgcagtaataactctcggaaaaattattactgattctggtattttattagctgaaattgaaaatgctgaagctgctatgacagcggttgactttcaagcaaatctcgaaaaatacggaattccaggagtagtagctctttatccaggcgaattaggcgataaaattgaaattgaaatcgtatctaaagctgactatgcaaaaggagcttctgcattactcccaatttatccaggtggtggtactcgtgcatctactgctaaagcagtgtttggatatggaccacaaactgattcacagtacgctattatagttcgtcgtaatgatgctattgttcaaagcgttgttctttcaactaagcgtggtgaaaaagatatttacgatagtaacatctatatcgatgactttttcgcaaaaggtggttcagaatatatttttgcaactgcacaaaactggccagaaggcttctctggaattttaactctgtctggtggattatcatcaaatgctgaagtaacagcaggagatttgatggaagcttgggacttctttgctgaccgcgaatctgttgacgttcaactgtttattgcgggttcttgtgccggtgaatctcttgaaacagcatctactgtccaaaaacatgttgtttcaattggtgatgctcgtcaagattgcttagtattgtgctcaccaccacgtgaaactgtagttggaattcctgtaactcgtgcagtagataatttagttaactggagaactgcagcaggttcatacactgataataactttaatatcagttcaacctatgcagcaattgacggcaactacaaatatcagtatgacaaatataatgatgtgaatcgttgggttccattagcagctgatattgctggtttatgcgcaagaactgataacgtatctcagacttggatgtctccagctggttataatcgtggccagattcttaacgttattaaacttgctattgaaactcgccaggctcagcgcgaccgtttataccaagaagctatcaacccggtaactggtacaggtggtgatggttacgtattgtatggtgataaaacagctacttctgttccttctccatttgatcgtattaacgttcgtcgtctgtttaatatgttgaaaacgaatatcggacgtagttcaaaatatcgtttgttcgaattaaacaacgcgtttactcgttcatcattccgcacagaaactgcccagtacttacagggaattaaagctctcggtggaatttatgaatatcgtgtagtttgcgatacaacaaataacactccgtcagtaattgatagaaatgagtttgttgcaacattctacatccaaccggctagaagcattaactacattaccttaaacttcgtagcaactgctactggtgcagatttcgatgagttaactggtcttgcaggttaatacggtgcattctaaaggcctgtttcggcaggccatataaatacactatatccttaattctttaattctatatgccctaggttaaacatagggatataaatactacagaggctaatatgtttgtagatgatgtaacacgagcgtttgaatctggtgattttgctcgacctaacttattccaagtagaaatttcttatcttggacaaaattttacgtttcaatgtaaagccactgctttaccagctggtattgtagaaaaaattccagtcggattcatgaaccgtaaaattaacgtagcaggcgatcgtacattcgatgactggactgttacagtaatgaacgatgaggcacatgatgctcgccagaagtttgttgattggcaaagcattgctgctgggcaagggaacgaaattactggtggaaaaccagcagaatataaaaagagcgctgttgttcgccaatatgctcgtgatgctaaaactgtaacaaaagaagtcgaaattaaaggcctgtggcctactaacgtgggtgaacttcaattagattgggattcaaacaatgaaatccaaacctttgaagtaactcttgctctcgattattgggaataaaatgaatggggagaaatccccatcctgcttaaagcagagaagtccattataaatataactataattcccatttggagaatacaatgaaatttaatgtattaagtttgtttgctccatgggctaaaatggacgaacgaaattttaaagaccaagaaaaagaagatcttgtttccattacagccccaaagcttgatgatggagcaagagaatttgaagtaagctcgaatgaagctgcttctccttataatgctgcattccaaacaatttttggttcatatgaaccaggaatgaaaactactcgtgagcttattgatacatatcgtaatctcatgaataactatgaagtagataatgcagtttcagaaatcgtttcagacgctatcgtctatgaagatgatactgaagtcgtagcgttaaatttggataaatctaaatttagtccaaaaattaaaaatatgatgttagatgaatttagtgatatattaaatcatctatcgtttcaacgaaaaggttctgatcattttagacgttggtatgttgattcaagaattttctttcataaaatcattgatccaaaacgtccaaaagaaggcataaaagaattacgtagattagaccctcgccaagttcagtatgttcgtgaaattataacagaaactgaagctggcacaaaaatagttaaaggttacaaagaatattttatatatgatactacccatgagtcatatgcatgtgatggtagaatgtatgaagctggcacaaaaataaaaattcctaaagctgccgtcgtttatgcccattctggattagtcgattgttgcggtaaaaatatcatcgggtatttgcatcgtgctgttaaacctgctaaccaattaaaattattagaagatgctgtagtcatttatcgcattactcgtgctcctgaccgtcgtgtttggtatgtagacacaggtaatatgcctgctcgtaaagctgctgagcacatgcaacatgttatgaacacgatgaaaaaccgagtagtatatgatgcatcaacaggtaaaataaaaaatcaacagcataatatgtctatgaccgaagactattggttgcagcgccgtgatggtaaagctgtgacagaagttgatactcttcctggtgctgataataccggtaatatggaagatattcgttggtttagacaagctctttatatggcattacgtgttcctctttcacgcattccgcaagaccaacaaggcggtgtgatgtttgattctggaactagcattacacgtgatgaattaacgtttgctaaatttattcgtgagttacagcacaagtttgaagaagttttcctagatccgcttaaaacaaatcttttgcttaaaggtataatcacagaagatgagtggaatgatgaaataaataatattaagatagaatttcatcgggatagctactttgctgagctcaaagaagcagaaattttggaacgaagaattaatatgctaaccatggcagaaccatttattggtaaatatatttctcacagaactgctatgaaagatattttgcagatgactgatgaagaaatagaacaagaagccaagcaaattgaagaagagtctaaagaggctcgtttccaagaccccgaccaagaacaagaggatttttaatggaaggtttaattgaagctattaaatcaaacgacctcgtagccgctcgtaaattatttgctgaagccatggctgcaagaacgactgatttaatcaaagaagaaaaaatcactatcgctcgtaatttcttaatcgagggtgaagaacctgaagacgaggatgaagacgaggatgaagatagtgatgataaagacgacaaaaaagacaaagactctgacgaagacgaggatgatgaataatgattctaatccctgaaactcatgaattagttctcgagaatgtcgaagcacttattcctgaagcacagggtcgctttgacgagttgtcttctgctttaaataaagacgatataaataaaattatcgagaatatgcttgatgatgaaactgatttagcggttgcattagcttctattaatgaaaatatgccgttaaatgaatttatcgttaaacatgtttctgcccgtggtgaaattactcgcactaaagatcgcaaaacccgcgaacgtaatgcatttcaaactaccgggttgtctaaagcaaaacgtagacaaattgctcgtaaagctaccaaaacgaagattgccaatccagcaggtcaatctcgtgctcagcgtaagcgtaaaaaagctcttaaacgccgtaaagcattaggattaagctaatgaatgaaccccaattgctaattgaaacttggggtcaacctggcgaaattattgatggtgtgccaatgcttgaatcccatgatgggaaagacttaggtttaaaacctggtttatacatcgaaggaatattcatgcaagcagaagtcgtcaatagaaataaacgtctttatccaaaacgtatattagaaaaagcggtaaaagactatattaatgagcaagttttaactaaacaagctctcggagaattaaatcatcctccacgcgctaatgttgacccgatgcaagccgctatcattatagaagatatgtggtggaaaggaaatgacgtatacggacgagctcgtgttattgaaggtgaccatggtcctggagataaattagcagctaatattcgtgccggatggattccaggagtttcttctcgtggattaggttcattgactgacacaaataaaggttatcgtatcgtaaacgaaggattcaaattaactgtaggtgttgatgcagtatggggtccaagtgctccagatgcatgggtaactcctaaggaaattaccgaatcacagacggcggaagccgatacaagtgccgatgacgcctatatggctctcgcagaggccatgaaaaaagcgttataaatattattatctaaacaacaggactacaaaatgcttaaagaacaactgattgccgaagcgcagaaaattgatgcttccgttgctcttgatagtattttcgaatcagttaatatttctccggaagcaaaagaaactttcggcactgtattcgaagctaccgtcaagcagcacgccgttaaattagctgaatctcatatcgctaaaattgctgaaaaagcagaagaagaagtagaaaaaaataaagaagaagccgaagaaaaagctgagaagaaaatcgctgagcaagcttctaaattcatcgaccatcttgcgaaagaatggctcgctgaaaataaattagcagttgataaaggcatcaaagccgaactgtttgaatccatgcttggtggattaaaagagctctttgttgaacacaacgttgttgttccagaagaatcagttgatgttgtagctgaaatggaagaagagctgcaagaacataaagaagaatcagctcgtctgttcgaagaactcaataagcgtgacgcatatatcaattatgtgcagcgtgaagtggcattgagcgaaagtactaaagatctgactgagtctcaaaaagaaaaagtctctgctctggtcgaaggtatggattattcagatgaattctcaagtaaattgagtgccatcgtagaaatggtgaagaagtctaataaagatgaaagcactattactgagggtataaatactcctgatactgaagcagccggactgaatttcgtcactgaagctgtagaagataaagctgcacctggtgcagaagatattgtaagtgtatatgcgaaagtcgcatctcgtttctaattttaaaggttaacacaaatgactatcaaaactaaagctgaacttttgaacaaatggaaaccattactggaaggtgaaggtttaccggaaattgctaatagcaaacaagcgattatcgctaaaatctttgaaaaccaggaaaaagatttccagacagctccagagtacaaagacgaaaaaatcgctcaggcgttcggttctttcttaacagaagctgaaatcggtggtgaccacggttacaacgctactaacatcgctgctggtcagacttctggcgcagtaactcagattggcccagctgttatgggtatggtacgtcgtgctattcctaacctgattgctttcgatatttgcggtgttcagccgatgaacagcccgactggtcaggtattcgcactgcgcgcagtatatggtaaagacccaatcgcttccggtgctaaagaagcattccacccaatgtatggtccagatgcaatgttctctggtcagggtgctgctaagaaattcccagctttggctgctaatactactacagttgtaggtgacatctattctcacttcttccaggaaactggtactgtatatctgcaagcttctgctatcgtaacacttgattctggcgcgactgatgcaactaaattagatgccgaagttaagaaacaaatggaagctggtgtactggtagaaatcgctgaaggtatggctacttctatcgctgaacttcaggaaggtttcaacggttctaccgataacccatggaatgaaatgggcttccgtatcgataaacaagttatcgaagctaaatctcgtcagctgaaagctgcttactctatcgaattagcacaagacctccgcgctgttcacggtatggatgctgatgctgaactgtctggtattctggctaccgaaatcatgctggaaatcaaccgcgaagttgttgattggattaattactcagctcaggttggtaaatctggtatgaccctgactccgggttctaaagctggcgtatttgacttccaggatccgattgatattcgtggtgctcgctgggcgggtgaatcctttaaagctctgttgttccagattgacaaagaagcagttgaaattgctcgtcagaccggtcgcggtgaaggtaacttcattatcgcttcccgtaacgtagttaacgttctggcttcagttgatactggcatttcttatgctgcacagggtctggctaccggctttaacactgatactaccaagtcagtatttgctggtgttctgggtggtaaataccgtgtatatatcgaccagtatgctaaacaggattatttcactgtaggttataaaggtccgaacgaaatggatgctggtatttactacgctccatatgtagctctgactccgctgcgtggttccgatccgaagaacttccaaccagtaatgggattcaaaactcgttacggtatcggtatcaacccatttgcagaatccgctgctcaggctccggcttctcgcatccagagcggtatgccttctattctgaatagccttggtaaaaacgcttacttccgccgtgtatatgttaaaggtatctaatctttgacgatttaagggaccttcgggtccctttagttgtttttatggtataaataaatcatataaaccaaaaggaaagcgcaatggctaaaatcaacgaacttctgcgcgaatcaaccacaacgaatagcaactcaatcggtcgcccaaatctcgttgctttgactcgcgctaccactaaattaatatattctgacattgtagcaacgcaaagaactaatcaacctgttgctgctttttatggtatcaaataccttaacccagacaatgaatttacatttaaaactggtgctacttacgctggcgaagctgggtatgtagaccgagaacaaatcacagaattaacagaagagtctaaattaactctcaataaaggtgatttattcaaatataataatatcgtttataaagtattagaaaatacaccatttgctgatattgaagaaagtgatttagaattagctcttcagattgcaattgttcttttaaaggttcgtctattttctgatgctgcagtaacaagcaaatttgaaagctctgatagtgaaattgcggatgctagattccagattaataaatggcaaaccgcagttaaatctcgtaaacttaaaactggcattacagttgaattagcacaagatttagaagcaaatggattcgatgctcctaatttcttggaagatttgcttgcaaccgaaatggcagatgaaatcaataaagatattctgcagtctttgattacagtgtcaaaacgctataaagttacaggaattactgatactggattcattgatttgagttatgcatctgcacctgaagccggtcgttcattataccgaatggtgtgtgaaatggtttcacatatccagaaagaatcaacttatacagcaacgttctgtgttgcttcagctcgtgctgctgcgattcttgctgcatcaggttggttaaaacataaaccagaagatgacaaatatctttcacaaaatgcctatgggttcttagctaatggtttaccgctttattgcgataccaacagcccattagattatgtaatcgttggcgtagtagaaaatattggtgaaaaagaaattgttgggtcaattttctatgctccgtatacagaaggtcttgacttagatgaccctgaacatgtaggtgcatttaaagttgtagttgatccagaaagtttgcagccatctatcggtttattagttagatatgctttatctgcaaatccttacactgtagcaaaagatgaaaaagaagcaagagtaattgacggtggagacatggataaaatggcgggtcgttcagatttgtctgttttattaggtgttaagctaccaaaaattatcattgatgaataaaacaaagggacctttcggtccctttttatttaacttaccaattcaatccaagccggacgaagtacatcttgtaccattttaactaattcctttttaatcaaagaaggattatccgcttgagttagagtaataccttcacgagaagtttcttccaaaatatcttgaacagttagtcccatcacctttccaaaatcttttggaccaatttcgccaattttagaaataacgttatttactcggtttagtgtaacgtaacaagctaaaatccccaccaatttgttatcagcttctgacagttcaactttagctttaataggcttatcagactttttcttttcactaaatttagaattcttgcatttgatggctacacgattgcgattaggcagccaagaaggataacaaggtttcaatacatatccttcagcggtaaatacttcgcctttggcttcagctttccaaacacatttgttagcgtcaattaaacctgcatggtctacggtaaaattataatcttggacgacagaatctaaatcatttggcaatttaataagttcttcaaatttaccacgacccaaaagtggagcgattttaaacccaaatgaattacaaaacgattccatcatgtaatcatcaacataagttacatcgccactttctgtagtgacaataatgtcaaatacataaaaatctttatcaccataatcaacattcttctgaatgccaggtccagcgaattcgccaaaaacttgataagtcacaacagctgaagtttccataatatcttgtactgctttaatggaatcagcgtaattctttagaataatttcatacccaaagaaatcttcagcaggaagaatcggtccagtacgtttagcgcaagttactttatcacgctcaataatcaaagaaaagtttgtgccgtgaatcttttcacgagctacccattcgccgccagtcaatcctaagctataaagtttttcaataaatttagagttgtaatgattttcaagactgctatactttttaaacataattaatcctcaaaatgtaatttctaaccaatcaccatcacgctgatcactattgactttaaagctgaatccttcttttctcagccaatcaccaatttcttcagtaatcaatttatcgcgagcagtgcaataataactaaaatatgttttaccttgttcagctgctttattagcaagttctgaaaaatctttaataaaacactctagcttaaactgtttactttttaatgctttttcacgtaattgattagcaaaagattcattttcataaagatcatactgttccatttttcacctttttattgatatgtctttttctatagacaactttttctcgagtttcaaatttattcttagcagtcatagctcgagcccataatacagccacttctttcgcctgtaagtttaattcacgagcaatttcaatgaatgactttccagactcatgaagagtaaacaccacaacctcagttctcataatcaatctcatgttatcgagttggtgccattatatacatcattttctgattgtgttttgtgtgctttcaaaatgaagaaaggggccgaagccccttatgattatggataggtatagatgataccagtttctaaagcagttttatgaatgatgtatccattacgtgattcttgaacatcaacttctggatagtctttcatcatcttctgaagggtgtaacgatgcaggtagtatttactatctggatcttcagttttccaatctttaccttcttctgtcattttttggatttcatccataacccaccaaccgcaccagatataagctgaagtacgatgtggaagaggatgaacataaggcaattcaccttctggttctggagcaactttatcagttacctgaacttgaccttctgctgtgatagttttgctatcataatcagtgacagtaacagtggcagtaacttcaatagtttgacttccgatagatgatgtatcaacggtgtatacattagttgattcttctacaggagaagaatctttcttccatgaatattcgatttgtgcttcttctggagcatcagtgacattagccgtaaatgtagccgaagcatcttgctgaacgttaatagaaggaggagtcaatgtaacttgtggattcattgtcttcttattaactgtcaatgatacttcattagaagtaacttccttttcattgtaattttctgccgttacttgcgctacgcatttaattctttttactccacttgtagttggagtatagttaaatgtagagttagtttctccaccaacttgtgaatcatctacataccatttatatgtagcagacgctccaacaggttgagaaaccaaggcagcagtaaattgaactggggttccaattactccagctgaaggactatcaggagttacggctaatgtagttgtctgcgtctttttattaacagtcagtgacacttcattggaagtaacttcctttgtatcataatctgtcgcggttacttgagctacacacttaattgttttaactccgcttgtgtcaggagtgtaattgaatgtagcgtcagttgcttcgcttacaggagaaccgtcaacgtgccattgatacgtagcagatgcacctggcggctgtgaatctaaggcagcggtaaattgaacggctgttccaatcactccagccgcaggactagcaggagttacagctaaggtagtcgtttgtgtcttattttgaactgtgatagttgttgtcgcttcagccgtttccgggcctccttcagaaagtgtatttgttgcaactactttaatagtcttttgtccagcaggtccttttaatacataatcaaaagttgcttcagctccatcttgtggaacattatctacagtccaagcatatgtaatagttccgcctccagtttcaccactgggtgtagcagtaaactgcttagtttcatcaataacccctgtcggtgttttaggagttatatcaactgtaaaagccataagttatccttattttaatgttacgaaagaagaattacgtgtttcacgaattagaactgatccgtcacgattaatgtagtaaattaagctaaataaagtttggtgcgccgacgcgtgttcaaaactagttgggtgagatttccaatccggagtttcagcaatccactggtaaatccaccaaggaacagtgcagaatcctggattttttccaatcagctgaagattcggactaaagttttccggaagagtaaatacagacggcttttcagattcaataatctcagctacagcctgctcgaatttttcttcaacaaaaggagtatcttcaatcaaaacatcggtattttcaggaattttatccgtttctactacttcaattttaatgtcagatttaaccggagaatcaatcagaagtgctgcttctggattgacttcttcatcgtcatattttaatccgtctgcagcatcagcagcatcaattaagtctttaatagataacccatcagtctctggcataggttcactagcgagcttctggagggcttcttcaatatcattaacgatattatcaaaagatttattctttttgacctttataccaaactgttcagcatattcagctaatttagctttagcttctttattatcatcaagagccttcagctctgcaatataatctttatctatcataatatttcctcagtataaatatagatatatttattactcggaaaatagtatgtaccactttgtatatgaaacaacaaatctaataaatggtaaaaagtatataggaaaacactctactgatgacttgaatgatggttaccttggttccggtaaggcaattcagcaggctataaagaaatatggtgaaaacaatttctctagaacaatattaaaagagtttaaaacttccgaagaagcgtacatgtatgaagaagaaattataactcctgaactaataaaaagcaaaaattattataatatgaaacctggtggaattggtggaattgttatgactacagaggttatagcaaagatgaaagaatcttccgctaaaagatttgaaaactcaccaggcacggtattaggtaaaacttgctacactaatggaactaaaaatatttttattaaacctggagaacttgttccagaaggatttgtaaaagggatggttcatcctaatagaaagtccagaaaaggatgtaaagtcaaaccgactaccacaggaactttttgggtcaataatggcgcaataaataaattaatacaaccagacggtattattcccgacggatttattaaaggtcgtctcatgaaaagagattctaaaggcaaatttagtaaggcataattatggatattaaagtacattttcacgacttcagtcatgtacgcatcgattgtgaagagagcacgttccacgaattaagagatttcttttcgtttgaggctgatgggtatcgttttaatccgaagtacaaatatggtcattgggatggacgaatccgtcttttagattataatcgtcttcttccattcggcttagtcgggcaaattaaaaagttctgcgataactttggctataaagcctggattgacccacagattaacgaaaaagaagaattatcaagaaaagattttgatgaatggctttctaaattagaaatctattcaggaaataaaagaattgaaccgcattggtatcaaaaagatgcagtgttcgaaggattagttaatcgtcgtagaattcttaatcttccaacatccgcaggtaaatctttaattcaagctttgctcgctcggtattatttggaaaattatgaaggtaaaattcttatcattgttccaacaactgctctgacaactcagatggctgatgactttgttgactatcgtttattcagtcatgcaatgataaagaaaattggtggtggagcatcaaaagatgataaatataaaaatgatgcgccagttgttgttggtacatggcaaactgtagtaaaacagccaaaagaatggttctcacagtttggaatgatgatgaatgatgaatgccatcttgccacaggaaaaagtatttcatctatcatatcaggtttaaataactgtatgtttaaatttggtttgtctggttcattacgtgatggcaaagctaatatcatgcagtatgttggaatgtttggtgaaatatttaagccagtaacgacctctaaattaatggaagatggacaagtaactgagctaaaaattaatagtatttttcttcgctatcccgatgagttcactactaaattaaagggaaaaacttaccaagaagaaataaaaattattactgggctcagtaaaagaaataaatggatcgctaaattagctattaagcttgcacaaaaagatgaaaacgcttttgtcatgtttaaacacgtatcgcacggtaaagctattttcgatttaattaaaaatgaatacgataaagtttattacgtatcaggggaagttgataccgaaacacgcaacgtaatgaaaaccttagctgaaaacggtaaaggaataattatagtagctagttatggtgtattttctactggcatttcagttaaaaatctgcatcacgttgttttagcacacggtgttaaatctaaaattattgtattgcaaacaataggtcgcgtattacgtaagcatggttctaaaacaatcgcaacggtctgggacctcatcgatgattgcggtgttaaaccaaaatctgctaatacgaaaaagaaatacgttcatttgaactatcttttaaaacatggcattgatcgtattcagcgctacgcagatgaaaaatttaattacgtaatgaaaacagttaatttataagggcttcggccctttggagaaaaagatgttactagaatttaaacaatttctttatgaagcttctattgatgaatttatgggtaaaattgcctcttgtcaaacattagaaggtctagaagaacttgaagcttattacaagaaaagagttaaagaaactgaattaaaagatactgatgacatctcagtcagagatgctttggcaggaaaaagagctgaattagaagattcagacgatgaagtagaagaaagcttttaaattaaaaaaggcccaaccaaaaaggaagggccaaaactatagactaaaggtcacactatagcaaaagttgtgtttcatttaattgttcttccgaactttctgaaactggtagttctttaatgtaattataacaaggcccaggatgtacaggacctttgtctgtttcaacaaccaatgcagaatcgattggagttttacagacaacgcaaatcttatctgacatgattgtctcctctaaattatatatatctatttatataactctcatatgcatatcaatgcccatatctttagaataaaaatattcatcaagatatccggcaaattttcctttaacataaagtacatcttcaccgcatgggtggtcggccaggatacgaatatcctgacgcttgagattatactttttcattaagaattgaatttccgtttcgaattcttcttcataattaaaagcatcatcaatgctatatttcattattttccagcctcaaatgctcgcatgtcttgaatatgcttaatagcaaatccgcgtgatttaatagcatcaagagctccgctacagaaatccaataaaattccccaatattgcaatgaagtatcaacttttaaaacatccttatcagctgatagaactgttttcatttctgatttctcgtaacgatccatactaaattcatcaccatctcctcgtcccgagtagtagtctaatttagctttaagagcaacttttttctgtgcatcaattctaagcatttcctttttaatacttgaatgcttattgagccatttactatataacatcacattattagctgcttcatactgtaatttagtcgaatctataaacacatctttcttcaattcttcttgaagatcttctaatttcatattgttctctattcaattgttattggatggacttagattcattataccacgtttatacgtgaagcattatactctgttactggaagccagttgtagttttatctgctcaatatcatcagggttatcgatgaccgaaaagcgtatttctactatcagagtataatcatcataaactggtattacattaactgctaatttatcaatacgcggctcgtagtttcttactgcgctttcaatgttacgctcaacagtatcagcagtaagaggagtcatattctcaaaaagctggtcagataaatcacatccaaattccgggtcaaatggtctcgacccttttctggttgtaataattcccaaaaggctatttttaattgaccttaatccaagggatctagaaacatctttgtcccaatccattttcatttctgggtcaatgtcagaataaagcttattaatatttgccattacaatagctcaaagaattctttgagtcctcttattacatgagcgtgagattttccacactctggacatttaattggaacagccaaataaacagtaggctttaaaagcatatcttttatagctacaatatctgactctgtgatgatagaatataaatcttccaactctttttcatttaagtcttcaactggaatgctttcaccgttagcatgaatcgtttctatacatgatactatcatgtgggctatatttttatcatcaaaaattttagggtaatggaacttaattttaatgtcacccagtgtataccagaggtcttctggtgcatctatttgtgtatgtaatagatttatatgggttggtatttcagttccacagatgcacttccaggagttttcgtgattaacttctccaagagaatgcgcccataaatgaatcaatagtagttctgattcttggcggtttaaatcttttgcatttgtgcattctttaattagctttttaacgatctcttctactgaaccgttctttttagcagtaataagttctagatattctttaagagtaaatgcgcgacagttgattattttagaaccaactctcacatcaaatttgtattcatacatatttagctcctttatttatcatatttataaatagaataaaaggagcatctatggcaaacattattcgttgtaaattaccagatggtgttcatcgttttaaaccatttacggtagaagattatcgagattttttgttagttcgaaacgatatagaacatcggtcaccacaagaacaaaaagaaataattgctgatttaattgccgattattttggagactatccgaagacttggcaaccatttatatttttgcaggtatttgtagggtcaataggtaaaactaaagtaccggtcacatttgtatgtccaaaatgtaaaaaagaaaagacagttccatttgaaatatatcaaaaagaattaaaggaacctgtttttgatgtagctaatgttaaaattaaattaaagtttccttctgagttttatgaaaataaagcaaagatgattactgaaaatattcattccgttcaagtagatgaaatgtggtatgactggaaggaaattagcgaatcaagtcaaatagaacttgctgatgccatcgagatagaaacattagaaaaaattctcgatgcaatgaatcctattaatttaacattacatatgtcatgttgtaataagtatgtaaaaaaatacactgatatagtagatgtgtttaagctattagttaacccagatgaaatatttactttttatcaaattaatcacacactcgtaaaaagtaattatagcttaaattcaataatgaaaatgattcctgctgagcgcggattcgtattaaaactgattgagaaggataaacaataatgagtatgttgcaacgcccaggatatccaaatctcagcgttaaattatttgatagctacgacgcttggagtaataatagatttgttgaattagctgctactattaccacattaactatgcgggattctctttatggccgaaatgaaggaatgctgcagttttatgattctaaaaatatccatacaaaaatggatggaaatgaaataattcagatttctgtagctaatgcaaatgatattaataatgttaaaacacgaatttatggatgtaagcatttttcagtgtcagtagattcaaagggtgataacatcattgctattgaattgggaactattcattctatagaaaatcttaaatttggcagaccgtttttctctgatgcaggtgaatctataaaggaaatgcttggtgtcatttatcaggatcgcacgttattaactccagcaataaatgctataaatgcttatgttcctgatattccatggactagcacatttgaaaactatttgtcgtatgttagagaagttgctctagctgtaggaagtgacaaatttgtatttgtgtggcaagacatcatgggagttaacatgatggactatgatatgatgataaatcaagaaccgtatccaatgattgtcggtgagccatctttaataggtcaattcatccaagaattaaaatatccattagcatatgatttcgtttggttgactaaatcaaatcctcacaaacgtgacccaatgaaaaacgctactatctatgcgcattcatttttagattcttcattgccaatgattactacaggaaagggagaaaactctattgtagtgtcaaggtcaggtgcttattctgaaatgacttataggaatggatatgaagaagctattcgtcttcaaactatggcacaatacgatggctatgctaaatgttctactgtcggtaattttaacttgactcctggcgttaaaattatttttaatgatagtaaaaaccaatttaaaacagaattttacgttgatgaagttatccacgaattatctaataataattcagtaactcatctatatatgttcactaatgcaacgaaactggaaacaatagacccagttaaggttaaaaatgaatttaaatctgatactaccactgaagaaagtagttcttccaataagcaataaagaagtttctattcctaaaatgggtcttaaacattataacattttaaaagatgttaaaggtcctgatgaaaatttaaaacttcttattgattctatttgcccgaatttatcaccggcagaagttgatttcgtttccattcatttattggaatttaatggaaagattaaatctcgtaaagaaatagatcgttatacttatgacattaatgatgtttatgtatgccaaagattagaatttcaataccaaggaaatacattttattttagaccgcctggaaaatttgaacaatttttaacggtgagcgatatgttatccaaatgcttgcttaaggtcaatgatgaagttaaagaaattaattttcttgagatgccagcatttgttttaaaatgggcaaatgatatttttacaactttagcaattcctggccctaatggtccaataactggaattggtaatattattggattatttgaatgaaaaagccacaagaaatgcaaacgatgcgtagaaaagttatttcagataataaaccaacacaggaagcggctaaatccgcttccaacactttatctgggcttaacgatatatctacgaaattggatgatgctcaagctgcttctgaattaattgctcaaactgtcgaagaaaaatcgaatgaaataattggagcaattgacaatgtagaaagcgcagtgagtgatactactgctggttctgagttaattgctgaaactgttgaaattggcaacaatattaataaagaaatcggtgaatcactcgggagcaaattagataaattaacaagtttactagagcaaaaaatccagacagctggaattcaacagactggaactagtttagccacggttgaaagcgctattcctgttaaagttgttgaggacgatacagctgaatctgttggtcctttattaccggctcctgaagcagttaataatgatcctgatgctgattttttccctacccctcagccagttgaacctaaacaagaatcgccagaagaaaaacagaaaaaagatgcatttaacttaaaattatctcaagctttagataaattaacaaagactgttgatttcggatttaagaaatctatttcaattactgataaaatatcaagcatgctatttaagtatacagtcagtgctgctattgaagctgctaaaatgactgcaatgatattggctgttgttgtcggaatagacctgctgatggttcatttcaaatattggtcagataaattttcacaggcttgggatttgtttagtacagactttactaaattctctagcgaaaccggaacatggggccctttattacagagcatctttagttctattgataaaattaagaagctgtgggaagctggagattggggcggattgacagcagctattgtagaagggcttggaaaggttctttttaatttaggagagcttattcaacttggaatggctaaattatctgctgcaattcttcgagtcattcctggcatgaaagacactgctgacgaagtagaaggaagagcactagaaaatttccaaaacactacaaatgcttctcttagcaaagaagaccaagaaaaagttgcaaattatcaatataaaagaatgaatggcgatcttggtccaatagcaaaaggactagacaaaattgcgaactggaaaactcgtgcatctaactggattcgtggtgttgataataaagaagcactaacgactgatgaagagagagcagaggaagaagaaaaattaaagcaactttctccggaggaagctaaaattgctttaatgaaagctaatgaagctcgcgctgctatgaatcgttttgatgaatatgctaattcagctgatatgagtaaagactcaacggttaaatcagttgaagctgcttatgaagaccttaaaaaacggatggatgatccggatttaaataattcaccggcagttaaaaaagaacttgctgctagattttctaaaattgatgctacttatcaagagctcaagaaaaatcagcctaatgccaaacctcaaacttctgctaaatcgccagaagcaaaacaagtccaggtaatagaaaagaacaaagcacagcaagctcctgttcaacaagcatctccttcgatcaataatactaataatgttgttaagaaaaatactgtcgttcataatatgacacccgtaacgagcacgactgctcctggtgtatttgatgcgactggagttaattaaggaataatatggcaattgttaaagaaataactgctgatttaattaaaaagtccggtgagaaaatttcagccggacagagtactaaatcagaagtagtaactaaaacatacactgcccagtttccaactgggcgtgctagtggtaatgacactacaggggacttccaggtaacagatctatataagaatggattattatttactgcatacaatatgtcatctagggattctggaagtcttagatcgatgagatctaactactcttcttcatcttcgagtattttaagtacagctagaaacactattagtagtacagtatcaaaactatcaaatggattaatatcaaacaataattcaggaacaataagtaaagctcctgtcgcaaacattcttttaccgagatctaaatctgacgttgatacatcatcacatagatttaatgatgttcaagaaagtcttatcagcagaggcggaggtactgctactggtgtgttaagtaatattgcttcaactgcagtatttggggcactggaaagtataacacaaggtataatggctgataataatgaacagatttatacgacagccagaagtatgtatggtggtgctgagaatagaactaaagtgtttacatgggatttgactccacgttcaacagaagatttgatggctattatcaatatctatcaatattttaactatttttcttatggtgaaacgggcaaatctcaatatgctgctgaaataaaggggtatttggatgattggtatcgttctacgttaattgaacctttatctccggaagacgcagctaaaaataaaacactatttgagaaaatgacatcgagcttaactaacgttctagtagtttcaaacccgacaatttggatggtgaaaaactttggtgcaacatctaagtttgatggaaaaacggaaatatttggcccatgccaaatacagagcatcagatttgataaaacgcctaatggtaactttaacggattagctattgctccaaacctccctagtacatttactcttgagattactatgagagaaattatcacgttaaaccgtgcttctttatatgcggggactttttaatgtattctttagaggaatttaataatcaagcaataaacgcagattttcaacgtaataatatgtttagctgcgtttttgcgacaactccatcaactaaaagctcttcgttgataagttcaattagcaacttttcttataataacttgggtctaaattcagactggttaggattgactcaaggcgatattaatcagggaattaccacgctaattactgctggcacacaaaaactgataagaaaatcaggggttagtaaatatcttattggtgccatgagtcaacgtacagttcaaagtttattgggctcatttacagttggtacatatttaattgacttctttaatatggcgtataattcatctggattgatgatatattctgtaaaaatgccagagaatagattatcctatgaaactgactggaactataactctcctaatattcgtataactgggagagaattagaccctttggttatttcatttagaatggattcagaagcttgtaactatcgtgcaatgcaagactgggttaacgctgttcaagacccagtaactggactgcgtgctttgccacaagatgtcgaggcagatattcaggttaatcttcatgctcgtaatggattacctcatactgcagtgatgttcaccggatgcattccagtgtcagtgagcgctcctgagttatcatatgatggagataaccaaataactacatttgatgttacttttgcgtatagagtcatgcaggctgggtcggttgatagacaagctgcgcttgagtggcttgaatctgctgctataaatggcattcaaagcgttctcggaaatagtggaggtgttactggattatctaattcgctttcacgacttagtagattaggaggaactgctggaagcatttcaaacattaatactatgacgggaattgtcaactcgcaaagtaaaatattaggagcaatataacaatggggaccgaacggtccccatatttttatttacggaatgaaataaaagcagcaactgaagcaactaaactgtcttcaatataaacttcaatttttaccggagcttctgactcaaatttacctgttactacaccctggaaaatgctttcagtctgttctggctttaaaaaattttcagaaggaaaaattccgaactttttatctgttccaaaaattttgataaattcatcataaactgcttcattaaaagcgttatcagcaggaataacgccttcaactacaagttcttgacctaaaaagcgtaaagaagatttcattttgtgttcctcatgttatgtcagtaaaactattgtaacacaacacgagggacttgtaaactacatcttgaactttttagacattccgttgatgttaaccaaagaagccaagatttgagaaacttcgttttcctcttcttttgattcttctacaaggaattgattaaacccagccattggacgaacttcaccagtttccattagatgatcgccatcatataccgattcttctaattgttcagaaggaggaacgattgtgccttcgattagatacttattataagcagtttctttcatcatgtacgtgctcactttattaatcttcagcaaaattccacgcggtaaaataacttcagcttctgatggaaatcctgataaatgacctggaacgataactttgattcgctcagcccctttaattaccatacctacgctagtttcagcgtcttcattcgcataagcagagtgactacccatatgcattaaatcttcagcatcaactgaaccttctccttcgccagaaaatactgcgccggaatcatctagagccatatagtttttaccatgctcaccgaagatatttggtttaagcgatgtggatacgaagttcttgaaatagaacattttattttcaatattatgacgtaaagttttaaaagtaacttcttgtccacgataaagcgtagttcctggaggaagaactgaacctttagcgaatgcagaatccattgtctcgatgtgtttaatagctcgttccatgtattcttcacgggtagaatctggtttacccaagaggaacgagttcatttcaacatatgaatctgcacaataatcttctattacatcagactcagcctgagttaatccttttggagttacttcggtgcttgcgtattcatatgcctgagcagcagattcattaatcaatttataaatgccattcataacaaattgaataatagctaccttttcgtctggcgtggctttagaacctttaactaaatcattgataattttcttaataacatcaaagctattagaaatattaatgtcagcgagatcgctcaaaattttatcggttttataatcaaaaaattctttattctttaaatattcttgagaaccttgatgtgttatatcgctctgcagtctgatagacggatcacgtaaacgtgcatgagccaatgcaatatgatttcggaagctttctagttcataatcgttagatttaaaacgagaagcacttctcataccaccgatagctcctttgctgaagtttgaaccaatctgaataacaccagagttcattggtccttctgctttatataccggaactttagattcaaactcttgatatttcttggcagcgaagctatcaccctgaagcgaagcatcgacagtagaatattgagcttgtgctgccaatcgacgactaattttagttttctgaataacagcttgatccgtgcgcttatcattttctaaagcaatagaagcagcaacagcaacagctttaggaacagcattacctgttttaacatctacataaacatcaccaacctttgattcaacttttgtgaataactcagttgaaataggaggtacacctggaatgtcttctaaattggcatttttacggtaaaccataatatatgcatactttttatcgtaatcccagatttcctttaaaagaacatatcgacctgctcctttagtacgtactaaacggtcagcaataacttgcatttgacgagctgcaccatttgttttactttttagtacgcggaataggcatgcgtcaattttatactgtttcattgtttgaagagcagtatcaaaaaccgcattaatgacaccaattggatttccacccaagtttttaagtttaactaatgatagtttctcattaacacctatcattacgatatgcatcattttatcgcctggcttaacgtttttatttgtatcaccgccagaggtgtatgtacaaaatctaaatccaggaagcacgctttcttcaccggtttgaatagcaaaaatttgaggtattttatgcttaggatttaagttaacaaccggcgccgaagcgccgtcaaataattctgtaataagttccatgatttatccttgaacgaacttgtaaggcatgtttgtaatatctatgcaagacgcaataattccaagagatgattctactttttgtttaacatttgatgaaacaaatgatgcaaagtcaactctgtcttctatttcaatatcacctgtcattgcaactacttcaccagtttccattagacggtcaccgtcataaatgactgattcggtgagttcttccgtagtcataacttcagcttgaatgagttttgtattattagatgttgttccgtcattattagaagcatcagttattttattaactttgaccatcaatcctcgtggtagaataacttcagcttctgttgctattccgagacttcctggatatacaacattaactttatgagctccatcaattgcccatcctatttgaactttaacgtattcaggattttctttatacgctcttatttcgcttggattaatagttattccttcttcatttttatcaactgtcaattcattacgagcttctggttctaaaagaccaataccagtatgcgtaattccaaaacgtccaaaaatgataggagttaaagaagtagatacaaaatttctgaaatagaacactttatttttaactagtgcttcgtatataggagcagtcatgctttgagcacgataaactgtaatgccttctggtatacggtcaccattttcaaaagctgaatctaagttatttatagcagattcaatttctttttcactcattacatcatatcgttctggattgtagcgtcctaaaagaagattattgatgtcagtatatcctgaaccgcaatactctctaatgccacgcttttgtgatggagtatatttagaaccatcacgggcaatagtaatatcaatcattggacctgcaccaattccagaaaagctgtaaatcattcttttgaggaatttagtttttgctgcgttccaggaatttttagtcatttcttcccagacttcatctggctgtcctttacgggttttattatgtttatcaagccaattatctttatattcttcaaataattgattaacagctgctgcgtatttctctaaacattttattgaagtagttggttcatttttaatcgcattaagaattacatctttaattttttcagaaacttcattaacctcactttttgaaaagaatttatagtcataatgaagttcatctgcagttccttcagcaataatttttgctgctttagttttagaagctaatgaattaattccaagcttcatttcttctgcttcgggaattaaaggagccgtagcaggtttattgaaattagctgcggtagattcatacttttggaataattcactttcaaatctagaagattctaatgattgactttgtgcaattgctctacgggaaattttaactttaacgattacagcttggtcagaacgtttatcgttttcttgcgcaatagatgcagcaattgcctcatttttagttacttgagctccagtatctttattgatataaacatcaccaacctttgattcaactttagtaaagagctcggtgctaatttctggaactcctggaatgtcttctagtgatacatttttgcgatgtataagaatatatgcatactttttatcgtaatcccagagttccttaagaaggacgtatctgccacctgaacgactgcggataagtctatcagcaataagttgaatttgacgagcttgaccagcagttttagacttaagaatacgaagcatacaggcatcaattttatactgacgcatcgtctgcatcgcaacagtaaaaactgaattgatgtaattaattgggcttggaccgagaccttttaatttagcaattgaacctttagcagttaatgtaaaaggaacaatatgcatcattttatcgcccatctttaaatcgcgattagtatcacctccagatgtataggtacataaacgaaagcctggttgttcaattgcgtcatcaacatgaactgaaaaaatttgtggtattttcttctttggatttaagtttgtaatcggaagagtagtatcttcgtcaaataattctgtaatgagttccatcatatcctctctagtgtttattctatttataaaattaaaggcccgaaggcctttaataatctattggtaagagagtacgatatatttcaaactttggacctttttcataggcatcaaatgtttctgcgaatttattataagcatatgcatctataaattcaatcataatttgtgatacagaagtagaaacatctccaccttctttttgagcaacgacaattgtttctaagtaagctttcatagaccagttacctcatgaaaatcaccaaatacatcctcgaatgtattagctttagttttatcttcacgtaaacgaatcgcaattggaagaaataattttacgtaatcagtgcggccatcagattttagccaaccgttgcattcgcactctagaatttttccaatataataattttggttttccataatgcgagtacggtcaagttcatgtgattttacaccggctttatcttttaagcctgaaccagcatttactttaatttttccacactctgattcaagaataaatccacctgctttagtagggtctttacggtgaggataaattcctacaatttttaaatcaacatcaattacttctttaaatttatagagattttttgaacgagcattttcccacaatccatcggtatttttgagaataataccttcaagaccttggtcaatatattttttataaattaccttagcttcatctaggttatttactacctggttttcaattaaaattactttatcatatcctgatgtcatttgttctagtttagaaaaacgtacatcatattttaaacgaaacgccggaagaccgtatatttctaccaacgggacataatcccagacctgaaacttcatgcatttggcttctttttcggaaatggttccttttaaggatttattggcgattccattagaagcagtacgagattccgctacttcggcgaattctttagctttactaatttcaggataagcatcaaaaagaaaatctaggccttctggttcctttttaacttgctcatggtataccaattcgccatcaattaacacaccttctggatgaatctggcgggcttcagcagtcattttgattaattcttccttaagaagatctaatcctagatattcattaccagctcgtgataaaagacgaacatcatctaattcatcgcctctaacttcagcaaaacaccgggctccatctgcttttaactgtgcaaaggctggaaatttgatattcttactaatgcccttttcatcataagaacttgccagcatttgaggttgttcaggaattaaacctggccaaactttgtttgcaatagatactgaagcaccgcattcaaggtctcgcatcatcactcgacgcaaaacttcaacatcatcctttttaccatcggtgatatatccagtcaattcctcaattgcagcatttccggtcaatttccgagtagctaacgtgaattcaatgaagtcaagcatatcggtaatagtcagcattccaaaactctgggtagcaataccaggtttaggccatttcttgatataatactgtaacccacgagaataagtcagacgatatacccgtttaagcaattcattatctttattcttttcaagaattgcttgcttctgtttagttgatccaatagatgctatttcattcagaattttaagaatcattgctcatccttcaaagtttggtttacagctctattataaatcaattcatcattaagctcaggcaaagacttatgatatgtagttctaactttatttccttgcatccagtgcttgacgtaaatgaaaccttgctctacacattttttaaaaattcgttcgtctttttgagctcggaattctggattgcatctaaaaaattgatttacgtgaccgtaatcacgtgtagtattaccttcattttcataaatagtgtgaacgacaaacattagaatgctccttggaaaatattatcaccactagtaaatctattaaaataccctgcatcaccaggcttagtataactccacgtatggaatggattcatatgatacgggtgtgtataatatggattatatggatgtgtataatatggattatacggattaaatccaggagttctccaggtagtgttccaacgaaaagaatcgtttttaaccatcttctcaattacatcttttatagctttttcattatcaaaactttctttattttccttcggcgaaaaaagcttattttctacatcattccatgtataaactcgctgagcggtttttggaatattgtcacgctctcctcgcgccatccaataaacaggaacatttaatatttcactcgcatgatcgcaatggtgagcgagatcgtcaatataacaaattacgttatatttctcttttgcctttttgaataactcttcttttgaagaatcatgaccacacatcattacttctgagaaggcaccaggaaaaagagcattcaaattaaattgacgattcaacagagcgtcaatagaatcacccaatgctgtaacagctacaaaattataatcttcttttaatttgttaattacacacagtgcatctttatatggagacaaataacgaataaaatctgatcgattatatttttcaattaacttgacaccaagttcttcatcacaattaaagagtttacccggagaaataaatttctcatcttggatcatttttaaaatatgttctaacggaagattatatttctgagcaaaataaggaaggcctgattgccagcttaaacatactccatcaatatcagtcaaaatagtaggcttcatagagagtctcttaataggtttaacacatcaataaattcagcttcggttagtattgtatcatcttttgttagaccactagccatgctgtgcttcaaaacttttcctttcgaggcttgtaatgcatcgcgaaagcccttgttttggaacgctgcttcaaaatatgcatttgtgtataattctttccacgctggggagtatcttgaaaacggaactccaagccagaagagggtcccacggtcctgagctctagcataagaccttccagcttgttgggcggcaagcccggataacccaaatatacgacgctgttgttcaacatttttcaccttgcatccttggaggaatccttcgagacctccaaattggataccatccataacaaaaggccattgggcgaaattacttaatgcacatgatggccatctaaaattgcttcttatctctaactcagacattttcaatacttataatttcaacatcagcccaatgaccatagcaaggaagacgaaattcaactggccagttagggtccttttctaatataatagactgaacttgtggctcttcatgttcatcggtatacggacctttatacgttactttatatgtaaccttaatgtactgaattccaaaaatcttattaattatattcatattaattcctttaatccatagataggagataattcatcacccatacgaaggtcttcatttccatctacccaggaaacaatataagcctcttttatttgaataccactccatttaaatggaggtagaaccttagaaattaatccaggtataccaactccctttaattcaacagtttgacccaaaaagaatttcattagaacctcatctgaaaaccatgcgatttaacattaccgccgccaatatcagaaatgttaatttcacgcgcaattgaagggtcaatgtcaatttcacgattaagtttagtgatagctaaagtatcgcgcccatttactgtacggaactctaaagggcagactacattaacatagtttttaatcgattcactagtaggttgcaaatgagcaggaaggtctttaggcgcctttgagaaaaccacttcacagaaatttttacgggtatcaaaataagtagtcataaacatagtattttcctcagtaaggggccgaagcccctcattttattttaaatatcaaattcgttaagaactacatcaaagattgcttcaagatgctcaggtttagctctgttactcaaaatatgacgaatccaagttttaaccagaagcttacgattgacgccattccagcaaggatgagtccctaaatcgcgttgacgaaaatcatcatctaaagcgattttaaaagaagaaccttctttcgtgattgaaaccgtgatgccattttcaaatcgcatataaacgtagttaggagtcatatactgttcaatttcgcatactgatccattttgatgtttccaaaggcagatagtatcaatagaacctgcaataccgttagaaacatatttacgttcaaagttgatgtagttcatttttattctccgagatgtttaattgcggtacaggtatataatatcatatcctgtaccaaagtaaactattttatgcaactttaatccaattatctaaatttaattcacctttggctttcattttttcaatcaaaagatcagcggtaatacgaccattttgataccatgtaacatcttcagaataaccagtttctttatcttcataagtctcacagcgaattttaccaagaatcaaagtttttaattcgtatgtatctccagtaaaaaagttagttaacattattttccaagagaaatcatcagaaggaccttcaggagtcatgcaacctacgaattcaaattgttctttatataaatgccactgaagttctttagtttcgatagctttatagccgtcgtgatctttacctttgatgtatgagttaagattgattttcattttattctcctttgtttgtgtaaaataatactatcacaaaggaactatactgtaaacaactttgtgcaatctttggaaaataaaaaaggactcccgaaggagtcctcaacttatgctttctgcttaccaaaacgagaagcatcatctcgaagaaccgcacgtgctcggcgcatgatcttctcaacagtttgattgatacgagagttcgacccacgcttgtagccagcgcgtttagaatcaccaactttcttttcaactgctttctttgctttagcttgttttgccattataaattctcttttaaatgaaaatgcaggacttattggcattgcctgcgcaagccctcaaggggaacataggtttttgaatatttaacgaccaggataaccataaacccgtcatcataccttatagctcttatctgttgcacaccgttagcttaaaggttccgggttcgatttctcgaggataagatatatactgatggatatataggccttgaggcgtactcccgattggccatcacctcggggtagcatgcacttgccgctataagaataacattcaagaggtacaccgtaaaactgccggggtcttaaaactataatgattcgcaaatcattaatcagacagttcgacggctcctcgttttaacttcacactaaggcagtgactctccaataaattacttcagtgttaccacaaagtgacgaactgcttttcgtgcagcagaagccagtggcttagcatatttaagttcatctttttcctgaagctcagcagctaatgcagtttgagcaggattcagatgtttgaaataactcaggatttcaagagcttcggcttcaacatcaatagatgcaccatagttttcgtgaccattattccatgcgtttcgttgcagttcaagagcgtgttgtaattgtttaatcatttaaaaattctcgttagagattaaaactcggtagtcacgttcttctgaatttcatcttctttcgacagatctctcagttgtagactaccacatagaattgaaactcaattcatattattatttatatcacttataaagacacggaatagctttatagtgacaagtaacgaatttttgtttaatttcttttggctgcttaagacccagagctacaaaaggatgcggaacgtttcgaatttgaccaactggaagagaagtcaaatcaccaacttcgcagaaaccttcaggaacatcaggaccaacagagtgaactacacacagttcaggaacttcaccttggacacgtttaccgataataagtcctgattctgtaacttcttcatcaccggcttgcgcaggttcagaaactaaaataacatattcaccgacagcacgaattggtagctgttgtacttcagacatcgtttttcctttttgttaacagatgaattaataataacaaataattcttaaagcatttatttaccaataaattgaagcaaatgctcaactttcataccattaacggaaatcaatttgtcaatagaaaaacctcgccatgcaccaagctcaacatcaaatactggaatcatatcagtagattctttccgagcagattcagtcaatttaccggtttgcatggttggcataaagtctgcatcacgagtacctttcatagtacgaatagtaccatcagacttttcaaaaactacgtttgaaatacccatggacaatttagttttcaaaatttcacgaattgctactttttgttcagtcgtcaatttcatttatttacctattacagttttaatatgagttgttccacgttctttaagagtggaaagcaacttttggcatttttctaaatcagatttccaactatacggcctatcaatacaaacccattctgacttataatactgtttccatttagagaaaaaatacttcttatactctacagcaaatgaaatgttctcgttagaataagaactaattgctgtgagctgtaccaaacgaaatttcattattcaccacagaattcgttgatattttcccaatttaacttattcaagtttttcttaggaacattaaacacttcaatacccgcatttcgcagaatatcatcccagccaggtttattcttatcgtatgtttcgcaataaaccagctttttaataccagattgagctatcgcttttgcacaatctgggcaaggagaaagtgttacatacatagtagcaccttcaattgaagaaccatttctcgcagcaaacaaaatcgcatttagttcagcatgaatttcatttttagacgaccattcagagtgagcactacgatgttctttcgccaagacaaaacgatcagttgaaccaaatgatacacattcaggcttatgaccttgaatgatagtatgtttaggcttattcagcaaccaaccttgctcagcagcataatcgcagcaattcacacccccggcaggtgaaccattatatccggtagaaataatacgtccattcttttcaattactgctcctaccttccaggagcaacactttgattcttgtgatactaaatatgcaatttgaagtactgtactcgctttcatttcataatcaccagataagcagatttagcagtttcaacacgataaatttcgtgacgaagtttagttatacttttaataacagaactaattatattctgcccatctttaaagcggtttttcttatcaataaaaattgcaccagccatctttttgtgaagctcaacaggatacttcgtcacaataatagcatcatacacagaaggatgaatactgttcaccagagtatcgttcattaaagttattctaatgaactgtgctgtttcagaatcaagcgctctatgatcgccagtatcattttcaagacaattatcaattatatcagttaaattcatcatagtacgccatacaccctttgtgcttcaactaatccatcaaaatccagtttaagatgtgttatttggtcaccatcacctggattcacaattactaatactgaacgaggagtttcggtaataacacgaaccgatgtttcaggaaatcgttcagaaaccttatttaccaattcctgagcaaatagtttaactttttcttggaattctttagtagtaattggtttttcacttagcatgttgatcccagctccttactttcaacgtttttaactaatttgacagaaactaattcggcatcttgggtaatcattaccgggccttcttcatactcttcaagatattctagagctttctttttagcttcttccttcgtatcagtttgagcatagatataaaacatacaaccagtaatacctactactttccacttaatttctttatcagttttaatttcaaatttactgatagagtcatctttttgaacttcttcgaaaaaataatattctgacatataagtaattgaaaatagcgggctttctttataagattcgcccattacatcaacagctttataccagcaatcgtcaatttcgcgtttaatgctaataacatttttcgcaggatctatttttactttaaatgaattttccccaataaactgagcaattcgtttattagccccacaagtttcattaaaaatatctttatatccagctttaaagcgataaaccttatcttcttcaaaccattcgctcatttcaatttcctcatttgttttggtagagctataatatcacaactctaccgtaaagtaaactattaaattgctttgaattctgatgtctgtgattcaaagcgaatatcgcctttgatgactagctcagcatcaagaccgaatacgacaataatatgagcagaacctggatacagagtaattgcaatagaatccacctggtctggaagcaaagtattcaatacatgagtcacttgagcatgaattcgaagctcagctgcattatcaagcttttcaaacatattattagcaataatttggctaaacactacttctacgattttagaataagttggaaacatatttacctcacataattttcttcaagccaatcaataacatccaacgcattatcaaaagttgaaccatctactttatcttctgtttcataatcaagaacatctaagcctactcttccatcaacaataggccataaacaaaatagatatttcttttctttttcaattttatcacaaagtcgataaatcttttctatgttattcataagttttccatggtaaaggcagtttagttttctttactgttagttcaacatcaggattcttttctcttaatttaaggcattcctcccaagctctgatttcactagtgaatacacaaaattgtccattactagtaccaactaaaccactatttacaataacaatagaccaagtttcatgatgccacgccattaaaaatctcccgagtcaacttgccagcattcaacaccgatacgacgccacatctcaacgacttggttacggtcatcaatagctaatttcacatcaaaatgcggtgcgatgtgtttccagaaaatttcttctttaactacatcatctttacgggtatcaccttgttcgcgttgacattgcataactaatggaacaccagcaatgtcctcaacccatttacgggtcatacgataatatttcgttgggtcttcttcagttccactttcacggcctgaaacgactacgatgtaatatccttgcttatcgtacatcttagctagttcaacaatcataggattgataacatcggtatcacatttttcaaggtcataaggaccgcgaccattcatttttgctagtgtaccatcaacatcaaaaataactgcttttggtttaccaggagtccctttatataccggaagaccgagatactctcgcatgcttttatacattgagcgtaaaacatcaattggtactgctttagttccgcgttttgagttacgtttaactagctcagtccaaggaacatcaaacactttatattcaactttccagccgtattctctagcaaaagtttcccatgctaggcgacgttcaggattcaggttagtgtctgaaataattactcccttgacagaatctccgccgtacagaatacttttagctgtatcaaactgcataccagttacgatgccttctttctttttggtatacttatactcgtcacgttcttcatggcccatgatggattgacgataatcatcacgattgatattataaaacccaggatttttagcaataaattcacgagcccaagtactcttacctgaaccaggacagccaatagtcaaaataatctttttcatcatttaattcctaagaaaacttcaagaatacgaatattatgctcacgccgccctttatataattcagctgttgattgattcaccgatttgctctgaacattagatgaaataaattttatcatgtgatttttaagctgatacatatcaagcccacgggcttttgcttcttttcgtaatgctttaccagcgtcatctaaagctttcgcagggtcttcatcatttaatactaccccacggtccaaatccatatatactgcaccgtggcatgcatcaatgtaacggtctgaacattcaatataacgttctaacagagttttcatttattatttctcaaccaatgattgaatataatcatgcaggtctttagatgctttaccccacttattttggtattcatttttaagattagcccgagattgagctaataaaacatcattagttggaggtaaagattctaaccgttgaatctggcgtccataaatcattgcagccatctcggattcataaatcaatcctttgagatgttcaaattgatgccatgaaatcatttgcatttatcctcttttaactcttgacgataataacatatcatagttttctgatcatgtacatatcgttttacatcattaagccaaatgcgaaattcctgggaatcttcaaatggcataccgacccaagctttaccatcaataactttaacttgccaagatagtttagcttcatcatatgactttatttgtacaggccaattaggatgaactgtttctttctttacttctagaggctttgtcgaacaaccaactagaagaccaatagataatattactgctgatagtttaatcatttagaaaggtcctggatgtcttctgcgaacttgttgaaggagttgttgatttgtttttcaaccaatcctggcttatgagccaccacatccgccttctttgcgtctttgcgcagtttttcattttcacgctcaatagcagcaattgcctcacgatttttattattcatcgcatcaatataattatactgaattcgcaaattatttaatgctaaagcgttttcattggccgtttttgtaatttctacaacagacgtttctaatctttcaattttattttttaaaattaaagaagttccgcccaatgcaattacaattaatagcaaacctgctgtcgtattacttaattgcataaagttttaataacctctataatatcgtcttgagaaagaccgttaattaaaatatgatgttcagctggagatttagaaattttaaagcatgcctcaacatcttctgccatatccgatgcactacgatttggattactaataccaaggcggtgttttcccgtcaaaggattaacgatgatatagcatttgcagttattgatatgaacattaggttgagtctgattaatgaacacatcacaatcatatttcgcaagctgattttctaaaaagactttcatctcctcaaccgcatcaggaagcatatcacgggcttgctcaagacgacgatttcgatattctttaatggtcgttttccgcttgacttgtttagctaaatctttcttaagatcggtgatatatccaactcgacgatttcctttaaatacagaaatcccatctgtagtatcaccgtatgcttcaacgaccatttcagtagtaataagctgtaaatccatcataaagtcctcatgttatgtcagtaagactactgtaacacaacacgagggacttgtaaacagcttagtatccttctgggataaattttttataatttttcaaaaaattctgttcgatttcacacatgaccttctcttgactatcatacccttggtagaggctcatgatgataccgaacagatgttccattccagcacctttagcaacgccttgtgcttccatcgcataagtctttctatctttgccgcaatgcttattgtgacagtcaagaactaaaaacagagctcggtctaagtacttcagataagtcgtctcaaatgcttcaatttttctatatgagtattcatcatcagcgtacattgctttaagatcatctgatgcaccatcaataatagtcttaaacaatttttctggattatctaatgaactttttgtgctgtgaagagacacgtaccagtcagacttaattttaaaatgagaaccatctttcatcacggcaacatagccttcgatgttttctgcatttttagcttcttcaacccatttagggctatcgatttcgtatcgttcaactagatatggacgaagaacagcatctttataaatgtcatcatatgaaatgtattcgcctgtttcattttcacgaatattcaataaaatgattttcatctcttgataagcaagaacgattctattcgtcggagcaacgaattcaaagttagcagtaaatccatcttcggctaattttttaagtctgtcacgcaactgatgatgattaatattcatcaaaattccattggccattaaagcctgttcagatttgattgaaccctttgatttgaacagaatttcatcaccgtctaaataagttgataccaaagacccatcttcttttgttagaatgtaatcaacatcatttaaatcgatattcatcgtgaatggattttcattcaagttaaaaaacttttccataggacgagaagcgattcttaccggtttttctccatccatttcaaacataattccacgacattctaatgcgtctggaagtaaccaatcagaataagatgcgtaattatatgagaaaattctataagttcttccagatgcacttacatcatccgagtaaaaaaacttacgctgcgaatccttacacagctccattaaattgttaaaaagttcttgcattgtgtatcctcttttgtgttttgaatatagtaccacactccatgtggaagcatcattttttcttgtgttgaatattccaaggcgggttaaacagtttaatgaatagcggctcctctaggtcaatcgttgcgattgtcattgtacctaactcatttgtcatagaaagattaaaacattggcgggcgtaaaattcaactttgcttccttcctttagcgcagcatgaattaatgcagatttagtagaatcagacgttttgtctttacgattaatagcagttctataatagtttattcttttacgtaaatttttagtttttccaatataaacaagctcatcatttatggcaatagcataaattacgttatacttgtttggaatagataactgttttatacttccgttgtcgtctaattctagctcagtatatttaataaatgaatattctgttgcaatttctttcataataaaatgggccttgcggcccactccttaaaaatattttttaaaactcatcataactttatcatcaacatcattatcaatctgtgctacaaggtaagatgacagttctacttcttgcggcgcggattgaacattatcagaattaaggtattcacgaatccaaggatatggatgtttaaccggagcatcggtaattggacatggaagaccacactgtttcatacgagatacagttaagtaatcaataaagctccacatgctatttgtatttaatccaggaacatcgccatctttaaataaatgaactgcccaatctttttcttggcggttaacttccatgaaaatatcaactgcttcttgttcacactcttgagcaattttaacccattcatcgccatcagtaccggattgaagttgacgaataatatattgggtgcctttaaggtgaagctgctcatcacgtgcaatgaacttcataatcttggcattaccttccatgatttccatgttcttatggaagttaaaggtacatgcgaaagatacataaaaacgaatagcttccaatgcgttgattacatgcaggcagaggtaaagagatttcattagtgctcgtttagtacattcaacaactttgcctaactcttctttacgaaatccttctgataaaattccttcataatcttcaaccgcattctgatattcacgagtcttaactagaacgtcatcataataacgaccaatagattcagcgcgtttcatgatagctttatctaatacaatctcatcaaatacctttgatggatcagtataaagatttcgcataatatgagtatatgaacggctgtgaatagtttcgctaaaagtccatgtagcaacccatgtatcaagacttgggtctgaaattaacgacataagtacagcagacggcgcacgaccctgaatgctatccaaaagtgattgatacttcaggttattagtaaaaatatcttgctgatattgaggaagcttattaaattgtgcagcatccatcatcaagtttacttcttcaggacgccaaaaaaatgataaagatttctcaataagttcttcaaatactctatgtcgttgaatatcataacgtgcaataccaagacctgaaccgaagaacataggttcttttaaaacatcaactggatttgtattaaaaactgtgctcataaattttccgcttagttaatagatagttatagattttttgataattcattacaatttacacgctgcacaatcttcagcttttggagtttctatttcataatcatcagtaccagaaccgtcacgggtattatgataatagaaattttttccgccaaaataccaaaaatacaaaaggtcatcaatcattattgacattggaacctttccttttggaaaaatctgcgggtcataatatgtatttgctgaagctgattgacacacccatttaagcataatagctacttgcgtaagataaggtttattaccttttttagctaatttccacgtataatcatagaggtctatgttatgctcaatattgggcacgacttgattaaaggaaccctcttttgattctttaacagagactggtccacgtggaggctcgataccgtttgtactgttagaaacttgggaagatgactcacatggcataagtgctgataatgtgctattacggatgccaaagagcttaaggtcttcccgcagcgccgaccagtcacaaacgtattttggagctgcgatttggtcaatctttttattgtaccagtcgataggtaattcgcctcgagaccaacgagtgtctgaataatattcgcaaggtcctttttctttggcgagcttaatggatgctttgatgagtccatactgtaatctctcaaatagttcatgtgttaaatcgttagcatcttcataagaagcaaaattacttgccagccaagctgcatagttagtaacacctacaccaagatttcgacgctttttagctttttctgcttcaggaactggatatccttggtaatctaaaagattatcaagagcacgaacttggacttctgctaattcattaattttatcttggtcttgccaatcgaagttatctaacacaaatgcagagagagtacacaatccaatttcagcatcaggactattcacatcatttgttggaatagcaatttcacagcacaagttactctgacgaataggtgccttttcacgaataaatggagtatagttattcgtattatcaatgaactgtacataaatccttgctgttcctgagcgttcagtcatgagtaattcaaacagttcacgggctttaatacgctttttacgaatattagggtctttttctgcggcttcatataattcacggaaacggtcttggtctttaaaataagaataataaagctcaccacccatttcatgcggactgaacaaagtaatgtaatcattctttccgaatcgttccatcattaggtcattcagttgaacgccataatccatatgacggatacggttttcttctacacctttgttatttttcaaaacgagaagattttcaacttccaaatgccaaataggataataagcagtagcagcgccgccacgaattccaccctgtgagcatgatttaacagcagtctgaaaatgtttccaaaaaggaataacaccagtatgacgcacttcacctgtgccaatcttagaaccttcggcacgaatcataccaacgttaataccaattccagcgcgtttggagatatattcaacaattgaagcggaagccttattgatagactttaatgaatcacctgcctcaataacaacgcatgaactaaactgtcgagtcggagtacgacagccagccataataggagttggcaatgaaatctgtcgagtagatactgcttcataaaaacgaataacgtgttttaatctatcaacaggttcatcttgatgcaatgccattccaatagtcataaatgcaaactgcggagtttcataaatttgaccagtggttttatctttaacgagatatttttcttttaattgcatcgccccggaataagtaaattccatatcccgctcgtgcttaatttttgattctaaaaatgtaatttcttctgctgaatattttgacaataattcagggtcgtatttaccttcatttacacagtaagaaatatggtcaataaatgaacgtggttcatattgtccgtaaacatgcttacgaagagcaaacattaaacagcgagcggctacgtattgataatcaggctcttcaactgaaatagaattcgcagcagccttaattacaatggtttgaatgtcatcagtggtcattccatcacggagatatgatttaatattttcatataattcataaggatctacagatgttccttcagctgcccaggataaaactttaataattttttgcgggtcaaagctctgagaaacaccactacttttgataacattaattaattgcataagtcctcaacttgaaaatcgtctttaaacaatcggttaactatatgagctattatatcaccatgacacggctttggtttacatgtgcatcctagcctcattccacgtaaaggctctaaatgtgctttagttatttctccggatttaattcgacgtataaaatcttttttgaataattcaatggcagcctcccggctgccagcatctttaccgacgtaatttccccaaaatgtaccacggtgaatattaacatcaaagtcggatttatatttattcactacccggcatagacggcacgcgtggtaataattcgtcatattgtttttccgttaaaacagtaatatcataataacaatcagaagaagttttaactgtagaaattttattatcaaaatactcacgagtcattttatgagtataatattttttgccataaatgataataggctgttctggtcctggaacttctaactcgcttggattaggaagtgtaaaaagaacaacgccagaagtatctttaaatcgtaaaatcatattgccattttccctttaattgctggatgcgattcataattttcaaggataaaatctttcggtttcatgtattcagttaaccagtaaagctgtgtttcggtgtcacaatttccaaactctataggccaatcaattttaagttcacatagttctttaggctcacgacgtaaaatttctttacattgctcagtatgattcatatagatgtgagtattaccaccagaaaatatcaaatctcctgggataagattacacatcttagccacaatatgcgtcaaggcagcgtacgaggcaatgttgaatggcaatcccaagaaaacatctacacttctttggtaccattgtaaatcaagataaccattacgcacattaaactgatagaacatatgacagggcggtaatgccatttgattgatttcagctggattccatgctgaaacgatttgacgtcgatcagttggtaattttttaatacgatcaatagtttcaactaattgatccacaccaccgaaatcacgccactgttttccataaattggaccaagttcaccactatgatatcctaggtctttagcttggttttcataattgtcatcccagatagttttaccttgaataagactaccatgagtacgaagacgtaaatcattaacattggtagaaccggaaataaaccatagaagctcagcaatacatgcgttccaggcgagctttttagttgttactgcaggaaagcctttagttaaatcccaacgcaatttagtaccgaacaaagcgattgttcctgtgcctgtacgatcatcggtttcataaccattttcaaaaatgtctttaattaaatcttggtattgtttcatttaacacctatataatcaatacggtttagcatcaaattttctctcaatttcaggtgtgaaatataattctttgccacgtttggaaaagcgaccaataatatgataattattctcatcaaacgtgatattaccaatatccatagctttcaaccaaatatcgatatttctatccagctttatgtcaaaattccaatacggagaactattaccgaaaatactgcaagcggattcagtgaaacaactgctgtaaatcttgtctttaggaactactaattgatagacacctttaataaactgaggaccctgccactttggctgtttcgcgtctttttctaataaaatagggtaataattaaaattcatattttccgccacgcgttatttcatttatatactgattccgtaagggttgttacttcatctattttataccaatgcgtttcaaccatttcacgcttgcttatatcatcaagaaaacttgcatctaattgaaccgttgaattaacacgatgccttttaacgatgcgggaaacaactacttcatccgcataaggtaacgcagcatatagtagagcgggtcctccaattacacttactttggaattctgatcaagcacagtctcgaatggcgcgccagaaattgacacttgaatttcgtcgccagaaatgtaatctatatattgctcccaagtaatatagaaatgtgctaaattaccatctttggttacaggataatcacgcgcaaggtcacataccacaatatgactacgacctggaagtaatgtaggcaatgactggaacgttttagcacccataatcataattgtaccttcagtacgagctttaaaattctgaaggtcctttttaactcgtccccatggtaaaccatcacctaaaccgaatgctaattcattaaagccttcgacggttttagttggagaataagcgaataccaatttaatcattacgcaaagcccctttcaataaaccattcagtggctttattagcgtcaaagaataattcttcatatgtcttttctttgttttcaaaaactgtcacacaaacacgttgacattctccacagtattcttctgacatgctcaaagcgtcagaaaacatttcattaaattcatttaaatcaggattatgcaatgcgttaaaaattgcataatcgaattcatcattcataaattcaaatacaaaaatcatattatctcctattaaaaaggatcaggaacatatccgctagctttaatcattttaattaacgttaacattcctttgttaactgctcgtgagatttcatcaaaaacttcatcactaaaaagttctaacacgcctttctgaacttttaatttacagccaacaatttcttcatcgcctatagtaaattcattaccaccaattccaccgaaaaacttaattacaccagttaactgtcttccacgagaatatgggtcgtgtgataaagtaatatgagtcaccccgggtacagttttaaattggcagcgaatatttacttgtgaaattccagttacatgaatgtcagacataatattttcctcaaatagactttttcacaattttccaatcagctttaaactgatcaacgtcagaatgataaatccagaatcctgcgctttctccatcctcataaagagggcatctatcacattcatcttcccatcccatatcgcgtaaaaggtgttcagctttttcaacaagttcagaatctttaccgatgatattaaaataccatttacctctaacttctgaatctttgatgctctggcgttgtaatctcattttattctccttagcaagctttaatcaaaagatataaacagaccaacataactgctgccataatataaggtgcgaacattttcttttctccattagttttgatagggtaatagtatcacactactaccctactgtaaactactttttgaaagttttttgcaaaagttcaatgatttcatctacattgttttcgtcaacaatgcagtgaatttttgttacgccagaaaccttgtctttgacttcatcttcttcagaagtcggttctttatactcacgaaaacaatgaaattcatcttcgcaaatttctaaaagtctatctttgaggtaaaaatgctttccatttgcgcattcaatgtgttttactgctttatatccattagcgacggaaacttctttaacttcaaaccatccgccattatctcgaatagctttaacgattgatgaattagaacgtgggctataattaataaatgtatcaataagtcttggaacaagttcatactttttgccaatatacattacgtttcctcattttgataggggcttaatagccccttgataattattgttcaatcaatcccatgtaaaattctgcgtcttcagaatccataccatcacaatattcattagccataaagcgagtgaggtcttcaagaggaccttcaataacgatttgaatactccaaaacttagaatcttgcacgcttgtgatactaagctcaggataacgattacgaataatctcttcaatatactcaaaatcaacgatgtcaatatcaactttagccatgttattttcctctttaattatcagcagtattgccgatagttgtatagtaccacggaagaacaaggatgtaaacagttttgtgaaaaaattttttgaaataaaaaaaggggacctctagggtccccaattaattagtaatataatctattaaaggtcattcaaaaggtcatccaggtccgtgtcatcagcactagatgaactgccagagcttgagctcataaaatcatcttcagtttttgtattaaagtcatcaacattgaatgcatccaaatcatcagcaactttatcagctttcttagcagcagttgctgcggcaccacccatagcagcagttcccataacttgactgaacttagtgctcagttcttcaaacgatttgaatttatctttagaagtcatttcagaaaggtcaaccatttgttcgaatagttctttctggaaagattcatcatcaatgtttggaatcgcagattgattcaggaatttagattcgtcgtagttactaaaaccagaaacttgtttaactttcagtacaaaattagcaccttcccacggacaagttacatcaaccggagtttcacccatttcaacatcaactgcaatcattgcattgattttatcccagattttcttaccgaaacggtatttaaatactttaccttcattttctggagcagctgggtcttttactacaagaatgttagcccagtaagaagttttacgtttaacaagaccatattctttattgtcagtgttgtacaaatcatttttactgatgtactgacatactggacaagaatcgtaatcaccgtgggtagatgaacagttttcaatataccatttaccatttttcttgaaaccgtgatttacaagaattgcgaatggtgcttgttcatcatttttagacggaagaaaacgaattactgcttgaccattacccgcattatcgagtttcagtttccactcgcctttatcttcagaagaaaaaccacctttatttccagccagtttagccatttgtgcagcgagttcagcagtagatttacgtttaaacatttttatttcctttttaatttaattaacagttggtgctatgacgatgtatgacctcatagctggtcagtgagataattataatctatttataataagcaattaatacttgcaagatttcacagtttcaataaaaacttttttagcttcctgtgaatcaatatttaaaatttttctataagcctttaactttatagaataattattccagactaaattatcagtctgttcatcatgtttatcaattatatttaaaaacgaatcaagcaagataaacgtttcaaacgaaattatgttcgattgcagaagtttaaaaatataacttgactgaacctttggattatattcaaagatttctttaaaagcagaaacttcaacttttttactaaaataataaatgttgcgaatatcttcttcaaacttaaatttaatttgctttaagcgtccgatatattcacgataaaacacaagtgcatcagcgtcagagatgtcaccaatccaagcatcttggttagcaacaagattgcttataaaaattaaagcaagttcctttaatttatatttttctgataacttctggaaaaaatacttatcccttcgcttttgataagcggcatcagacacccgcatgcaccaattatacttaattacatcatactttccattcatatgttgttttatcattaagtataatttataaactgatttaccatcaatatatctttcaccaccagcaggcatgcggagtttaatcataatagaaaatctaatgtattagttttttcacaacgaacaacagaaggacgtaaaagattttcgtcaatagcttctgactgaattttttcaattatacccgaaggaataaatttagcaaattgagtttcaggaatagaattttcttccaagaatgctgttgtagcttcaagataactcattccaaactcttctaccattttttcaataataaatccattttcttgacggtcaagaagctttgcaatttcatccttttctttcttaattgaaagttctttttctgaaagcccggcctcatcgaccgggcgaatatcatttagagaaaactgtgtcataaagttcaactacctcttcagtttcagcttcaaacacatcacggttatctttatgatacaaagctaatagacgattaaacatcttaccatcaacgccaagttcatctttagcacgaattcgaatatctttaatcagttcattataaccggaaattttcagtttatgatcagatgcttctttaataaatttagccaagtcttcgccgtggatagcttcatcaaattcaaccatttcttttttagccattattcacctcaaaattcattaatgctattagttaatttagaaagacccgcttttacaaaatatgaataaattttgccacgcggtggtaatttatatgaattataataattcacaatgtttgaagcaatattatcaggaatataatcaaaatcaattagaactaaattttctttataacgattatattcagattctgtgagaagcaccttagcttgctcacggtcattagcaatagcttcaacgattgaagttttcattgaaggagttcgttcaccttcaactttggtaaaccaaaagtcagatcgtactttaactgaagcaacgttatcctttttgtcgcctttaaggattttagtcatacagtcaatttcagcagaaccgcttttaattttaacccatttcttgtgcatcggtgaccattgcttaacatttgggtatttgtgaagttgagtaaagtcaccatccgatgaaatgattaaaatcttatgcccttctaaagagaactttttaacaagaacagcaatatggtcatctgcttcatacttatcaatatccataacgatgtatggcatataagctttcaattcatctataactttatgactggattcaaaataaccttcccagtcccaagtagattcttctcgtgcttttccacggtttttcttataataataagcaaaatcacgacgccagtatccagatttcgcgttatcaatacacaatacaattttagtgtatccaagagtttttgcttttttgacattaaacttaattgagttcaatatcaaatgacgaaccattgataaattaattttttctttatctgggaagtttaccaaagcagttgaaagcgcaatttgactaaagtcaattaagcagattccttctttgtaatcttcatccagcatcatttctaaatccatatgaacctcgttcaattagtgagatttctattatataccatccgaatcttaaagtaaacaagtataaatacttattattgaaaacacaataggagcccgggagaatggccgagattaaaagaaagttcagagcagaagatggtctggacgcaggtggtgataaaataatcaacgtagctttagctgatcgtgccgtaggaactgacggtgttaacgttgattacctaattcaagaaaacacagttcaacaatacgatccaactcgtggatatttaaaagattttgtaatcatttatgataaccgcttttgggctgctataaatgatattccaaaaccggcaggagcttttaatagcggacgctggagagcattacgtacagatgctaactggattacggtttcatctggttcatatcaattaaaatctggcgaagcaatttcggttaatactgcagctggaaatgacatcacatttactttaccatctactccaattgatggtgatactatcgttctccaagatattggaggaaaacccggagttaaccaagttttaattgtagctccagtgcaaagtattgtaaactttagaggtgaacaagtacgttcagtactaatgactcatccaaagtcacagctagttttaatttttagtaatcgtctgtggcaaatgtatgttgccgattatagtagagaagctgtcgttgtaacaccagcaagtctctatcaggcgcaatctaatgattttatcgtacgtagatttacttctgctgcaccaattaatgttaaacttccaagatttgctaatcatggcgatattattaattttgtcgatttagataaactgaatccactttatcatacaattgttactacatacgatgaaacgacttcagtacaagaagttggaactcattccattgaaggccgtacatcgattgacggtttcttgatgtttgatgataatgagaaattgtggagattgtttgacggggatagtaaagcacgtttacgtattataacgactaattctaatattcgtccaaacgaagaagttatggtatttggtgcgaataacggaacaactcagacaattgaacttcagcttcctactgatatttctgttggtgatactgttaaaatttccatgaattacatgagaaaaggacaaacagttaaaatcaaagctgcaggtgaagataaaattgcttcttcagttcaattgctgcaattcccaaaacgctcagaatatccacctgaagctgaatgggttacagttcaagaattagtttttaacggtgaaactaattatgttccagttttacaacttgcttatatagaagattctgatggaaaatactgggttgtacagcaaaacgttccaactgtagaaagagtagattctttaaatgattctactagagcaagattaggcgtaattgctttagctacacaagctcaagctaatgtcgatttagaaaattctccacaaaaagaattagcaattactccagaaacgttagctaatcgtactgctactgaaacccgtagaggtatcgcaagaatagcaactactgctcaagtaaatcagaacaccacattctcttttgctgatgaccttatcatcactcctaaaaagctgaatgaaagaactgctacagaaactcgtagaggtgttgctgaaattgctacgcagcaagaaactaatacaggtactgatgatactacaatcatcactcctaaaaagcttcaagctcgtcaaggttctgaatcattatctggtattgtaacttttgtatctactgcaggtgctactccagcttctagccgtgaattaaatggtaccaacgtttataataaaaacactaataatttagttgtttcacctaaagctttggatcagtataaagctactccaacgcaacaaggtgcagtaattttagcagttgaaagtgaagtaattgctggacagagtcaagaaggatgggcaaatgctgttgtaacgccagaaacgttacataaaaagacatcaactgatggaagaattggtttaattgaaattgctacgcaaagtgaagttaatacaggaactgattatactcgtgcagtcactcctaaaactttaaatgaccgtagagcaactgaaagtttaagtggtatagctgaaattgctacacaagttgaattcgacgcaggcgtcgacgatactcgtatctctacaccattaaaaattaaaaccagatttaatagtactgatcgtacttctgttgttgctctatctggattagttgaatcaggaactctctgggaccattatacccttaatattcttgaagcaaatgagacacagcgtggtacacttcgtgtagctacacaggtcgaagctgctacaggaacattagataatgttttaataactcctaaaaaacttttaggtactaaatctactgaagcacaggaaggtgttattaaagttgcaacccagtctgaaactgtgactggaacatcagcaaatactgctgtatctccaaaaaatttaaaatggattgtgcagagtgaacctacctgggcagctactactgcaataagaggttttgttaaaacttcatctggttcaattacattcgttggtaatgatacagtcggttctacccaagatttagaactgtatgagaaaaatagctatgcggtatcaccatatgaattaaaccgtgtattagcaaattatttgccattaaaagcaaaagctgctgatacaaatttattggatggtctagattcatctcagttcattcgtagggatattgcacagacggttaatggttcactaaccttaactcaacaaacgaatctgagtgcccctcttgtatcatctagtactgctacgtttggcggatcagtttcggcaaacagcacattaactatttctaatactggaacggcaactcgtctgatttttgagaaaggacctcaaactggaactaacccagtacagacgatgactatcagagtttggggaaatcagtttggtggcggttcagatacaacacgttctactgtatttgaagttggtgatgaaacgtctaatcacttttattctcaacgcaataaagctgggaatataacgtttagtatcaatggtactgtaatgccaataaatgttaatgcttcgggttctttgaatgcgaacggcgttgcaacatttggtagttcagttacagccaatggcgaattcatcagcaagtctgcaaatgctttcagagcaataaatggcgactatggattctttattcgcaatgatgctgctaacacctattttatgcttactgcatcgggtgatcagactggcggatttaatggattacgtcctttagctattaataatgcatctggtcaagtaactattggtgaaagcttaatcattgccaaaggtgctactataaattcaggtggtttaactgttaactcgagaattcgttctcagggcactaaaacctctgacttatatacccgtgcgccaacatctgataccgtaggattctggtcaattgatattaatgattcagctacttataaccagttcccaggttattttaaaatggttgaaaaaactaatgaagtgactgggcttccgtacctagaacgtggcgaagaagttaaatctcctggtacattgactcagtttggtaacacacttgattcgctttaccaagattggattacttatccaacgactccagaagcacgtaccactcgctggacacgtacatggcagaaaaccaaaaactcttggtcaagttttgttcaggtatttgatggaggtaaccctcctcaaccatctgatatcggtgctttaccatctgataatgctacaatggggaatcttactattcgtgatttcttacgaattggtaatgttcgcattattcctgacccagtgaataaaactgttaaatttgaatgggttgaataagaggtattatggaaaaatttatggcagagtttggacaaggatatgtccaaacgccatttttatcggaaagcaattcagtaagatataaaataagcatagcgggttcttgcccgctttctacagcaggaccatacgttaaatttcaggataatcctgtaggaagtcaaacatttagcgcaggccttcatttaagagtttttgacccttccaccggagcattagttgatagtaaatcatatgctttttcgacttcaaatgatactacatcagctgcctttgttagtttcatgaattctttttcaagcaatagacttgttgctatattaactaacggaaaggttaattttcctcctgaagtagtatcttggttaagaacagcaggaacgtctgcttttccatctgactctatattgtcgagatttgatgtatcatatgctgctttttacacttcttctaaaagagctatcgcattagaacatgttaaattaagtaacagaaaaagcacagatgattatcaaactgtattagatgtagtatttgatagtttagaagatgttggagcgacaggatttcctaaaagaacatacgaaagcgttgagcaatttatgtcagctgttggtggaactaataacgaaattgcgcgtttaccgacttcatccgcgataagtaaactatctgactacaatttaattcctggcgatgttctttatcttaaagcgcaactatatgctgatgctgatttactcgctcttggaactacaaatatatccattcgtttttataattcatcaaacggatatatttcttcaacacaggctgagtttactggacaggctgggtcttgggaattaaaggaagattatgtagttgttccagaaaacgctgtaggatttacgatatatgcgcagagaactgctcaagcaggacaaggcggcatgcgaaatttaagcttttctgaagtatcaagaaatggtggaatttcaaaacccgctgagtttggtgttaacggtattagagttaattatgtctgtgaatctgcttcacctccggatataatggtacttcctacgcaagcatcgtctaaaactggtaaagtgtttgggcaagaatttagagaagtttaaattgagggagccttcgggttccctttttctttataaatactattaaaataaaggggcatacaatggctgatttaaaagtaggttcaacaactggaggctctgtcatttggcatcaaggaaattttccattgaatccagccggtgacgatgtactctataaatcatttaaaatatatacagaatataataaaccacaagctgctgataacgatttcgtttctaaagctaatggtggtacttacgccgcgactgttcgatttaatggaggagtacatgttccatatgctataaacaatacaaaccaaagcggtgtttatccaggtaacggtgatgcagctacttttgctacagcaaatattgatattgtttcatggtatggaattggttttaaatcatcacaaggatctgcaggtagaactgtagtaattaatgcacgtaatggtgatattagcacaaaaggcgttgtatctgcttcaggacaagtaagaagcgatatgactgctccagttgcagcaaatgatctcacaagaaaagattatgttgatggagcaataaatattgttacggataacgcaaattcacgtgtattgcgtagaggcgatactatgactggaaatttaacagctccaaactttttctcacagaatccagcgtctcaaccttcacatgttccacgatttgatcaaattgttattaaggattctgttcaagatttcggctattattaagaggacttatggctactttaaaacaaatacaatttaaaagaagcaaaactgcaggtcaacgccctgcagcttcagtattagccgaaggtgaattggctataaacttaaaagaccgtactctttttactaaagatgactcgggaaatattattgatttaagcatttctgccggtggtaacattagtggaaatattactcaaaatggtgattatttacaaaacggcacgtataatcttaatggaaatcagtttgtttatgcaggaaagtatattgaattcttgccaaaaactgctggaaatggtgcttgggcaaatcagcacttgaataaagcccctatctttacagatttgagttcagctacctcagggtctgaataccatcctctgattaagcaacgttataaagacggtactttttcagtaggtacattagtaagcgaaggctcatttagagttcattatattgattctacagctccagacaattctaaacactgggtctttaaccgtaatggtaattttattgtagattctggcagtcttgaagttcgcagtggtaatatttctgcgtcaggcaatattaactctgctaatggtattatcaccggtcctgaaattgttactaaaaatattaatttcagtacaaaaacatttgtctctaacgccaacatcgggtatgattgggtttctttacctacttgggtttataacccaccggctgatggttctgataatactactaatggtttaaactatttgcgtaaattgcgtgcatcaagtgcatcaagtattttccatgaaattgccgattgccgaaaaggtaagccacaagaaatttcttggtggactggtattggaccatcatctttccagtgggcgtttgatacctccgggcgtattactgcaggtaaatctatttccgtaggtcttccggatagtggtgcgaatggacgttatccattagattcagctatttctattggtattgccattggtgataacgatacaggtattaaatgggttcgcgacggcgttatcgatttaatggccaacggtatttcttcggctaccattttgaacaatggtattaacagtactaaaaaattgatggttggttatagccgtgattccggaactacatgggattacccaaataacaaccaagcaatgtttactgcgcgtaccgatgttgatggtaataataatggtgatggtcaaactcatatcgggtatagcagtaattctaaaatgtatcactatttccgtggcacgggtcgtatgtccattagtatgggtgatgggcttcttgttgagcctggcattttagatattaaaactggttcaaattcgttaaatttgcgtgctgatggtaccatcgcttctgttcaaacattaaaacttaataatggattatattttaatggtgatggaactaatgcttctctagtttttaaagcggcttcaggtattgatggcaccaaacaaatcctttgggaaggcggtactcgtgcaggccagaacaaaagttatgtgaccgtgaaagcatggggtaactcatttaatgctactggtgataaagctcgagaaaccgtatttgaggtttctgatggccaaggttattatttctattctcaacgcgtagctccgaccggttctgaaactacaggccctgttgtaactcagttcaatggacaggttaatgctagaggaagcttaataaccgacggaagtcttagagttaacggattaagcactctagttggcaacgttacaatgaataatggattgtttgttcaaggtggtgcctcaattaccggacaggttaaaattggcgggactgctgatgctttccgtatttacgatgctgaatacggggctattttccgtcgttctgaagataagctttatattattccaactccacagaatgttggtgaatcaggtggtatttctaatttacgtccgttctatattacattaagtactggtaaagtttccatggatcatgatgtagatatcggcggcggtagatttaaagtagaagcggctggaactacggctggtcaacgcataacagtaaatatggcatcagatgctattagaataaatgctccaacacaagagtcttctaacttcattcaaggacgtaaagcagatgttccgaaatggtatttaggtattggagatggcggcaacgtcgttcgtatgcacagctacacatattcacatggtattgcattaaactctgattctgtcgatattactaaaccattaaaagttggtaatgctcaattcggtactgatggtaatattactggtggttctggtaattttgctaacttgaataccacaataaataaccttaagacagatattgtctcaagttatccaattggtgctccgattccttggcctactgatacacctcctgaaggttatgccataatggaaggtcaaacatttgatgctgacttgtatcctaagttagctgctgtgtatccttccggcactctgcctgatatgcgtggtcaaactatcaagggtaaaccgagtggtcgtgcagtgttgagtgcagaagctgatggtattaagtctcataatcatagtgcttctgcatctaatactgatttgggtactaaaaccacatcaagctttgattatggtactaaaacatcttcaagctttgattatggtactaaaaccagtaataccacaggtaaccataaccatacggtgagtggaactactgccgcagcaggtaaccaccaacacgcgcgttcaggtcctcaggtacaaggcggcatacccactagcgtattctatgacggatacaatactgtaggtccaaacggcaacgctaaattcactgcaaccgtgagcggtgctactgcatcgtcgaatatggccaaaacatcaacagaaggtaaccatactcatacttggtcaggtactactagcgctacgggtaaccatgctcatactgtaggtatcggtgctcacactcacactgtaggtatcggtgcccactcgcattcagtagcgattggttcgcacggacatactatcactgtaaatagtacaggtaatacagaaaacacggttaaaaacattgcttttaactatatcgttcgtttagcataaggagaggggcttcggccccttctgaatatgaaaatttatcactattattttgacactaaagaattttacaaagaagaaaattataaaccattaaaaggcgtaggatttccggctcattcgacaccaaaaaaacctttagaccctaaagaaggctatgctgttatatttgacgaacgcgagcaagaatgggtatatgttgaagaccatcgaggaaaaacagtatggacatatgataagcaaaaaattgttattgacactccaggtgctcttcaaaatgttactacagaagaacctggtgaatttgacctttggaccgacgacgggtggaaggaagatgaagcatataaacgtgtagttcaacgtgataagaaaattcatgaactctataaattattcagtgttttaagttctcttattgacgcagaggttgctaatagagaagaaaaacgaaaatttaaagagctcaaaaaattctttgcccttttagaaaaacatgaacatcttggcggcgaattccctaaattccctgaccttgaaaacaaatctattatcaaagcgattataaatatctttaagtaaggaggtattatggcaacaccaaaagtatcattttcgcttagtgatattctatttgggttgctagatcgtattttcaaagataacgctaccggaaaggttttaatgtcccgagtggcggtaattattcttttgttcctaatggcactaatatggtacaaaggaagtattttgttggattattatgtaagagctaagtatgatacttatactgaaataatccaaaaagaacgagctttacgttttgaatctgcggctctagaacaactgcaaatagttcatatctcatctggtgcagattttagtgctgtgtattctttcagacctaaaaacttaaattattttgtcgaccttatagcttatgaaggcaaactacctagcacaatttctgaaaagtcccttggcggattcccagtggataaaacggccaatgaatatataattcatttaagtggccgtcatttctcatctaaatcagaatttgcatttttgcctacaaaatctaagactgccgaactttcttatatgtatagttgtccatactttaatttggataacatctatgctggaactgtgacgatgtattggtataaggggagtaatatacttgaggaagatcgcttagcggctatatgcaaccaagcgatacgaatactaggaagggctaaataattagttgttagaatacatcgctaaatgacgataaatattttcaaaaccttcattgaattcactaatcagtgttttcttttcttcggcagttaaatttgtaattagttttctgaacgaattctgatttagctgccgaccatcttttttaattccaatctcattcaagaatccgatgaaacttgctcggtcttcaacaatatcttccctagagaatttaatcaaaatagaagcaatagtaataatttcacgtacgatttcaatgtctttattcataacgttttattcattccacttggttgatatggatatagtaccattatcagtgttgattgtaaacggccttttctacgcttttaacataatcaatgtagacttcctgttcgtacgagtgtaaggctaagaacggagctaatagttcattatagactaaagcctcacgctcacgttcggcctctactacgttctgaagattatgactcatattgttccttataactatcaatgtagtcctgtatgtcgaagaatgacatttcatattctagggcattaagagcccgttcttcagtatagtcagaaccaaagacgatagtgatttcaccaggcttcatgtgattgaaatcgacactaaaaggaatacgagaacatacttcgtcttccatatctacgataacactacgacacacttctcggttaacctgataaagctctgcaagttcttcacatcgaataacaagttcagtggcaggattttctttgattttagtaagcatagtctttacccttatgtttttgtttacgtttagattgaagttctgatttctttttgtccttatggacggaagccttattgaaatcatgttttgctacaagattgttcataatgatttataacctcgtttaaacatttgtctgtgaaagaaaactttttagccacagaacattctataatgtgctctttcaaatctttagagtcagtatatcccatctcagtaataaagtgacgaattaaagctttattcttatcattaacagaattaaaataatctgctttagaatcaattattctcatcatctaatttccttaattgatactgcaacgagctaataatttcttcgttcattttaatatacatgtcgcgcaagaaaggttttaacccatcacgaataattgctaacgtatcacctttacataaattaaccaaataaggatggtctaaagcatcccaaccaggctgattagcatacgtaccataattttcttccatcatagcattcaggcgtttgatatgattaatatgggcttcaatagcatcaatctggagttgtttaagattcattagtaaaggtcctcagagtaaagttctttttcattaccaccacgttcaatacgtacttgtccagcgtaagttgcaataatcattgcttcttcacgtgtccaataattactatattggtcaataaacccttggtcatcatcacaaacttgttgagtaactaattgaggtttaactacatctaaaacttctgccatatctttagaataatgacgagcacctggaataataagagttcgtccatcttttaatttaaaacggttggctgcacagacaattcgtcgttgatacttttggttttcatcccaatatgcaggctgccaacagatttcaggaacttctttcagaatatcttcttctgtgcatttataaccatgcgctttaaatttttcaacaagactttctggagtttcacgagataaaggaacattcagcatttttaaacgattaataaatgggttcatttaaaccatcctttaatacgttgccacaaagttttctgctgagctttgttaacaccaattgaacgaataaccggttgagattcctggaattctttataatcggcaaggtaaatttcgtaagctgcatccgtaaatgaacttatcgctgccataaaattattacgaatacctactggagcatctttactttcacgaataatcatgtatttaccagtcttaatctttacgatagttccaagataagctccgtggtaccaaatatcccaaccctcttgagtaggttctgcgcaacgacgaagttcattaacaatttctaacttgttcattatttattcctcacagttcagatgctacagtgattacagcttcaatgttttctgccgagcgtttaatgtcaagatacacattaccgtttttagcgattttacatgacattccgatatcagtaaatttctgaatatgatgttccatcattttgtatccaaaaattcgcatatttccattgttgttaatttcaaaattacgaattccatgagtgcgtttttctaaaatagcaagatagttactgcggtaagtttcaacctttttaagaacaaatccattttcatctaaaagttttaacatgagatctttatcttcttccatatcggaagtaatctcgcgagctttacgagtagcacgttttttcagaagttctggagcattttcctgcgcatataaagttgctgcgtttgaaataatatcttgcgcttcgcctgtgatgattaatccatcacctgatttctctaccaggccttttttaatcaataccccaatattactattaactactgcgttacctaaatctggatgcacctcacgaacttctgcagctgtaatgaaatctttcttagcaatagtaattaaaatcgcagcggttttttcattcagaacatcgttagaagctttgatgatgtaagttactttagacattttctaatctccgtaattctgtatcagtagttgatagttgtatagtaccacagtatgctttggttgtaaaccgttttgtgaaaaaatttttgaaataaaaaagggagagcctcagctctccctaaaattactgcatgactgtgataactgtcatgataacacgttgaattccgaacgcaagaagacctcctgctacggctggaacaacacctaaacccgccagtaaaatgctaccggatactaatgcagcgcttgtaataccaatgaatggactcatttgatttcctctaaatctttggtgtattcagtaactacatcagtagttttccaatattcgttttcttcttttttagctttagcttcttcagcaagtttcttcgcttcatcggaagtcatatgaaaaatattcattccaactagtttatcaacataagaagaatacatatcgattttcgaaagttcttcggtcagttctttacgagttttaccctgtacaacaatttcacctgaaattactttcttaatgaaatgtgccttggcaaaggctaaacgaaaagctgactcagtttctttaattttgttatcaattcgtttttggacataagttttacgaacttcgacgaagtctttgattaaatcaactacgttatcgtaaacttgcagttttcctttctcattaataaccgtaatattctgagaacgacgctcaatcaacccaaagtctttcataatttttgcatggcgttcttcttcgttatcgctcaaagaatattctttacggaatttaactttgaagccaaagccatgctcaccacaagcatcatcccatgtaatgaagcctttatcttcaagtgggtctaagattttactcacataagtttcacgatcatacttatacggaatctcagtgatattcatttgagttcgtgaagtaaacttgtacgttccacgaatttcatattgaccgtcaatctcaacgacttcaccacgaaattctgggaattctaccttcggtttagttactttctttccttgaatagcttgcagtacagctttcttgacagaagaaacactatgaggaagaatgtaagttgcataaccagttgcaataccggaaacgccattaagaagaacagtaggaataataggcaaatagaaagcaggcggaatgtgttctttatcttgatgtaccggagcatattcagtatctttatacacgttatagaaatttttacttacacgagcaaaaatataacgactcgccgctgccttttgaacggtacgagaaccaaagtttccttgaccatctaacagaggaaagttattattccaagtgttagccatcaaagctcccgcatcttgcgcagagttttcgccatggtgatatccaaggtccgctacaccacctgcgatagaagcgagcttatgaaacttatctttatttcctcgtgccaaatcaagagctcgagcaataacaaatcgttgaactggcttaaatccatcaatcatatttgggatagcacgattttcaaccgtgtacatagcataagccaatgcttcattatcaatgatactttttaaatcgcgattattcagttgcataaatttaccatactagtgaatgtagtgccataataacatcagaaatgaaaagcacgacttgaattaatccgaacattactccataatatagtgctactaataaagtagcaagggctaatgaatagcccaagattttcttaatcattagtagataacaacacaaatgttaaatatgcacacataccctgagctaaagcttgcgaaaacacactgctagcatcgatacagatagttaaaacacatgctactatccagcaaataaatgaaataactcctaataattttgcgatattcatattttcctcactggcgtccgaagacgcctttagttttaagattattacgatagaactgcatcacatgttcgttatggaaattactcattaatatgcctgcaaaacaaatttaaagttatcagccaacatacggttcatttcttcaagtgtttgatactcagaatgatgattacgagtaaacgctaaagctaactgtccttttccaaatcccgtcgtcagaggtttcatcttagaagcaggcagataaaatactgtgtatggaacattgttatttgcaatagtacgcgcaagctgagaccggcgttgacgaatatgacttagaactgcgctgaatccttgcttagaacgctgattacctacataaaatcgtgcagacacacatggattactaaatggacgaccatctaatttactcactaaaaagtaaaatccaggtttagataaaacgtctttatgtggagttcccaaaaaccactcaccgcccttgattgtaccaataacagtagcgcctgcattattcagatcagtaacagtcatatatttcatattaatttcctctaaattattttctactccaaggccgcatgaatacacgcggccattaaattaatcgtcgcagtcgacgctcaattcccaaaactcttctacggtataagtttcagtatcattttcaatacagaaacgttcattactgttatttgttaaagtagcattaactgtcggtttctcgctagtgctcttaagaggtgaaatgcgaattaactgatcaccgttatctaaacagaaaatttcaccaacttttacatctttaaagcttttcataattcacctcaaggagtataaaatccgaatgcagttgttgaccatcccatccaatatggaaaatttgcaccaatgtaaaacataagaatataaaaccaaatgctcagtaaattcattattttacaccattccaaattgtttcaactacagattttaagccattttgatgaatgtccattccgacaactgccatcaaatagattccaaccacaactgaacccaaggcgaaaatcagcatgaaaatgaataaagccggaaaaatattatcgaaaaaccattcaataaatgtaaaagcactacgcttacgtttcatattttcctcacataaatccaaaataagcgtttaacatatcaatcattaaaacgattgggaatatactcaaaactattagtattataactacattccatatagctttaacaatctttttcattttctgttcctccgtagttgatagggtaatagtaccacggaagaacagtcttgtaaacaacttttttaaaaatattcgtaataaatgtgaataccaatcactactgccgaaacttgcgcaacccaccacgcacaagcaataagtacagaattaaaaattttcataataacctcatcacaaaagtaaatgttaaacaaatcaatggaatactaattaaccaaacaaaacaccaccataatgaactcatagttcaatctcaatgatttcaagattattttctttaatagctttctttaaatcatcgtaaataagaacttcccaagaattgtttaaatcaccattcagcaaacgctcttgttgcaatttatcagtaagatatggttgatctgattcatatttagacaatcccaatgaaataaatgatgttgcatcgtcaatttcagaatattgtacataaacaaattcacctgtgattttatgtttaacataaaagaatttaaatttcatttttgttcctccgtagttgatagttgtatagtaccacggtccttgtggtatgtaaactagtttatgaaaatttttagatggaaagataccatccgttgtagttgctttttcgcactaccttacgaaggtcttctctatccccaatgaactttggagtgtactggatgacacctggatgaatttctttagtgttgaatataattatacagtcagcgacttgatgatttagaatgggccctagatttattccagaaccgtatggatactctccgctgtatcctgtcgttactgaaatccatcgagagtcagtttggtgtgttttaacttctacccgaagcccgcagtattttggatgtgctaaaacatcccatgcatatgtatacggatcatcgacgtcttcttgacctttgttaacatacccacttaaccaatctgctacaacatactcagcatacactgcgatacggcatctttcaataacttctgctttatcctggttcgggttttgttttaaagagtatcttgctgtatcagcaattttgaccttcatttcactagtcaagtcactgttcgatagggtaaatgtcggaatctgaaatagtctctgtaaacccggattcgttttctgcatttaaactttcctttatgtcggaatcataatttctcttaaaacaaaagggccgaagcccttattttatttaaattgtgcgattcttttctctagacactcagcataagatttcattgagatgaactgtgaaagcagcagttcttgctcaactgcactaaccgttagaaactttgtgctttctaaaaatttgctcagtgcattaattttgagcattaattgatcgtattcttcttttactcgtgcttgataacctaacataattttccttaatatgataagggccgaagcccttatttaaattgttcagtaacgtcttcaactacttcgtattggcaggtacgcattttagcatcgttgtaatcaatcggaattgatactacatcacgtggatgtactttaacttttacaactcggctggttgaactgccaaagtgacgaatataagatttagaacacacatgcagaccacgagaacaagtttgtgtatcatcgtcattcacacgagtacgcggcattttaactactttaccaggactgttatcaaaggtgtttgagtgacagtcaaagtagttgtcacgaactactttccaagcatagaagtaaccatcttctgtaatttcaatatcgtttgctaccaagaaatcaaagagtcgagataccgctttctggcttgggttttccagcagattttccaagaacggaaaataaaattcaaagttttcacctttttccatcgaatcaagaatacgatcaaccaaaccagaccgcaattcaatattttgatagaataagcttccaccttcaattcgaacatcgccggaaatatatttttcaacagcgcgacgaacattaattttttgtgccgcttcttccagcttatccgctacaagcagattgagaatttcctggaagtttgaatgagtattaggtgttgcgttataagttacaccgtcaacagtaattgaaatgaattttttagatgcattccaaataatgtcagatttagcaactggagcaataactgcatcgctattaactttaattgtaatatcaccgctaatagtaactttagagcgtttagcttcttcagcatttttcaaaacacgacgaattgtgtcaaccgatacaccttgccaatcagccaattcctgttgggtgtaattaccacttgaatacagcttaacaatttcagcttgttcgtttttggtcaggcatttaatattgtacat

SEQ ID NO: 3 - DNA, 164690 bp, Unknown
  Bacteriophage genome sequence derived from the Myoviridae family
  misc_feature (1)..(164690): n = A,T,C or G
aatatcacctcttaaaatttaacattcttaaccagtttcataaagtcttgtgcgcgtttgtcgttatgcagaatacgataccagttatctacaatatcatacagtaacgggctattctctttaaacttcgcacaaactgctttaattcgttcgtttgctgccgtgaatttttcatcacaaatctttttagtttcttcgtccataatccaacgagtacgaaggagtaacttggaaacctctttattataatgacgaccgtacagtctgtcaataaattctggaatacagcgttctagttcatcgtcatgaaacaacatagtgatcacacccagatattcgccataccccagatgattggtcttaaccttcttagccagaccagccagcttaccgcgaacaaattctagcgcacattccaattgttcgtcaacgagatatttttgtgtctcgtttcgagtaataatatactttgttaccccgaagtagtcaagcgccgtgtgtaatgtattttcactatagatcgatttacgactacggctttcgaatgcatcacctacgcggaacatgtgcaagcctgataactcgcgaatctctgccgctttcatgtgatggctggttttatgccaactgtcaccaatcttttccatgatatacacgttaggcagcttgggagtcgcttcacgttgtgtacgctcggtcttttccggtttaactgctttagcacgcagatcatcggcctctgataccttaatcacggtcatttcagaatcatcataatactgtttgatgtactcgaaagtctccatatgtttttcgttgttctgacggaacaccagtacctttttattgatgccgtattcttggaccatgccgttaagagtcagtgcacgcagtttcggtttatcggtatcatcaataagacacgtaatatcttctttatgcatccatacaaaatgcgtaatgttgtattgactgctaacgaaagcagggcgcaatttgctgattgtgtgacgagtacgatacagagtatacacctgaccttctacgtcatttggcgaatctttacccgcattcacaaacttattatagattgctaccggatcatcccactgcccgatcttacccatcttgctaataatattgcgttgagtcgatgaatactcgctcataaattgcgcaagtttacgctctgttttaatgttggcgatcttttctttaaccttttccaacatcatttcattgatttctgcaatgcgtttttcgatgttcgctttagtctcaattgacaagtgaacttcttcacgcgatggcatcaggtccagatcacccaactcaaaattaatgtaaatggtctggtgctggcggtttacagcttctaaccatgttccgcgaacatattcatacgggatcggatactggatcttacccatgattgcatatactacataggaatcgttatcacgcccattacaaacataataattatcaaagctagggaaataattaatttcgattgcattgatattcggtttgtgttccccaaaatgacgcagtacaaattgcgcttctcgatgccatgtctgaatgtctttttctttcaccggaatagtgattttcagaccgttgtcttcataggtcggttcgtcgaaaatctgcaccattttcggcatagagttttgcacaaatgcagtaaagccataagcgcgaccattgtagtagtttacgattgtaaaggtgtcagtatagctataagcagacttcgcacctaaaccaaaagatccgatataatcattagtctggtctttggttgattcaaagtaaacagtaaacagttgttctaattctttcttagacggaatacccgtaccataatcacgcacagagaaataaggttcaattgcggtaggcaaatgaatatcaaacggacgatctaaggttccggcttctttgtgggtgtcggtagcattacatgaatactcacggacacaagcacgttcacaatattgataagtgttcttagaaagcaccataaaagccttgctacttgctttcagagaaaaatcaaccgcaccgctcaagtcactgccaaatacttcttcattatcaatatgcattttcataatataatcctcacttaattaaaatcttctttgtccatctctgcgtggattacatccaacgcccataaatcaataaacgcattatatgtcacggtgcaatcgttgtcaatcacttctttcgcatatttcttgatgttttcgtaggaaacttgcggatcaattttgtgtttacgaaggtgcgcatattcatacctcaagcatttcataaacaggtccatcgatttcttttctcgatggtacttggcgaacataaaatcaaaacttctattcattttctactccttatacattttcaatcacccattgcagatgggcttctgcgtcaaccagttcagcgcggcttttctctaagcacttgctgtattctttacgttcccaatcagcaatttcgtttttcaggacttcttcatagtaagcaattacgcctttcagatcggaaactttacggcttgccagttcgatgtaatggttacgcattttgattctcctttgttactagataacgaatttggtcttgcattgcaatcagttcccagcgtgctactttcatcatagaaaccgactctttgaacataatattagctttttccttatcccctgtcaagtagatttctgcaatttttttcacaaaatttttgagtttcttcattcttaaacggtttcatataagtcaaccttttgttttcgatggggatattatgatatatccccgatccagtgtcaacagatttttaatcttttttcagtgcatccattactcgctctgcgatcagttctcttaagcactgataaccatgatatttgatggcaatgtcacgcagatcattaaccagttcccgtacttcatggtctttcaaatcgtctctgtatttcgatttaaccgtgtctttaggtggattgcgaataacctgaaaaccttgttctgcaatcactgcggcttcgcgctggcgttcatgttgtactgtatttttgatcaggtctgcttccatgaactttgccatactcatcatcatgttattctttttgctcattattaaatcctcataaaagaaaagggagactcccattatagagaatctcccttgtatgtcaactaaaatttaaagatgcaaactccccgtgatgaatttttgcatattcatcatatgctctagcggcttcctcctgagtagcaaacgatcctatgtattttctgtatccgtttatccttatttgtgcttgccacggtcttttgctagatcctttgcgatgagtaacaccattatatatgctcgtgcacccgtccattttctttttattgtacatgttttgttgttgtgttgcctcccgtaaatttggtggattgttgttttctggattcccgtctatgtggtctattaccttaacctgtgttccatattcaagaaaccagacaattctatgtacaagatatgtagatgttctctttttaaccttattgtaaacatctattgccaaatgaccgtaatttaacttttttgtttttactttatcaccgactcggtagaaatatccctctggtagaccattaaaagacggactatttgttttgtgatatagaacaccttccgtgtgttcaaatctgcgttttaattcctcttgaatttcagtattccaaaatttcgcacttttcatattatgacgccatccatgccttcctcatgtctgaatcttcgctatagagcaaatcgaatagctctttatagttttccggtaacgtgatgatctccatgacaggatcgttgatcacgcgatgatagtctgattctgtgagcgatgctaaacctttgatatatcgaatgttgtaacctttgatattatctcggtcgttctcgaaatcttctaggtcataataccatcgaacatcatcacctttctttggttcagcaatgataataggtgttttgataaaccggattcgtccatcttcgaacaattcaggccaacgtgcaaagaaagagatcagactaggtttaatagacccgatcccgtcagtatcagcgtcggtcataatcgcaatatttttgtattgcataacttccaatgcatcaacaccaaattgcaagccagtgatcgccatgatgttaaaaatttcggcgttcttaacgatctttgcctccggttgttcccacgttgtaagagttttgcctcgcaacgggaaaccgccatgtaaatcttgatcacgtacagagatcagatagttgatcgcggaatcaccttccgtcaaaaacagggtagtttctgcgtcagttccaataaggttagctttaacgtgttttgctaccttagcccgtttcgctgcctttgctgccttagtcgctgccgctttatctgctgcctctttgcgtgccaggactacagcaataataggcatgataatgttttctttcttcgcaatgactttagccagctttttaaaatcaagatcaatatgacgcttgatatcaccagttggattagtcaatcgttcttttgtctgtgaatcaaaacgaaggttaggcaattcacgaacaataagaatacaggtcaatccagatttaaccgcagctttagtaacatcaaccttatattctttcttgattcgttttacaatctcttcacaaagatcatctgtcacataatcaacgtgtgttcccccgtttttggtaaacagaccattagcaaaggatactgatttaaaaccttctccctcgaccgccggaactagagcaagtgaaaagtttttatcttcaatgacaaacggatcatcattgtatagtttagcataatccttgaacttactaacaatgcgtttaccattaaacttaaacgtgatcttaggaaagattacgctcaatgattgcagacgatcatgaacaatatctaaaacagagttgtccatcatataaccttcgaagtggtcgaagtctgggcaaaatgtaacctttgttcccttcaattttgatggttttgatgaccatgtgatattttcagcaccgtttgtgcattgaacggtcatttctgtttcgccgtcacaggtcacaccagtaaaccaatcgctaaagaaatttgacaacgacgaccccacaccgttcatcccttgcgttaatcgattggtatcatcaaagttagaccctgcttttgttcgtgtccatgcggccacaggttgcggaatctgcgtaccctctggggtagtaaccatatgttgaggaataccgcgaccgttgtctgttaccgtaacaatattgttttggatatcgacgctaatcacattggcaaattcaaaattagtgcgaatcgcctcgtctacagagttgtcgatgatctcatcaatgattttaaccagtcctggaacatatgaaatttttgtccatttaccgaacaggaaacgttggtgttcttcgtaagttgttgatcctatatacattcctgcacgcttaaggacatgttcacgatcagataaaatgcgaaactcactcattattaaacctcttcataacataaccataacttactgcaaccgccacaaagacggctgcaacaatcatattaaaaattgagtgattgtcaagtatatgactcatgacacgcgcacatttttatcatagtacccgccattaatcccgcgcggggcagttaatccctgtttgcattctttaccacattcagggcattctgccttttcacgctcggaaattttgcggattttctgaaattgaccgtgttcttcacaagaataatcgtataatggcatattatcccctttgtttcttaactgaatttggatctggattttctggtaggtcttccagacccatagcataacgttgtgcatagattagcataagaatatcgcgagcgcaatcatgaattgcatcatgtgcgataaaaccatctagcgtacccattggtaacggacactcacacatcccgcgatgcatcaatgtacgctcaatggcggtgcgaacatctcggatgttccagaatcgcacaggttcaagattgaacgtctctcgtgtattgtgtgcacggcggatcatatcaactagtaacggaatatcaaacgcattaccgcgtgaccacattacggatttaaccggatctactcctacggcttcacagaatgcgttaaaacgcgctaaaccttctttagttgatacttccgtaccatttgtgattaattgctttctcatgccttctgaggcggtattcttccaccattcaaccacaccatgatcaaacacccttacacctttctgggaaggaatatcaaattttaccagaaaggaattgtcaaccagttctttaaatgtaggtggattgtgcggatcttctttaaatccgattgccgccatattgataaccgccccatcaggcggataacctaaactttcaaagtcaatcattaaatccactggaagcattttaaatatcctccgcgatatgccggaacaactccagatcgtttttatccagaatgaaaccgctacaatcaataatcccgttaccgtaattatcggttaacagtcgttccgttgccatgtatgcgcgtactttgttgttaaaattcattacatgttgtgcatagtcacaatgaatcttttgacggttccacgcgacaattgattgtagatgtattacattagccacattattaataacaaccatatcaaaaccctcgcttagtggaatgttctggcattttattgatacattcagcttggtagtcacgagatttttttgacgaattaagagctacagccaaaaaatcctgtaactgttcgtttgtcatttttggcttacaccgcgtatctaaacccttcgttcttctagcttcattagccatatcaaaaacctcgcttagtgaaatgctcgatcattttattgatacatgcagcttcactatcgccggacacgttccagccgtatagaccccatctaaagcacatggtaacagttccattgtgacggcttaccgtcacatcattaaattctgggatacttcgcataatcataataatttcctcaaatatagtctactcgatacctcgcacgggtaacacccacatataataactgcattgccaattcaaagtcaacattgtctgtacacatgcaaggagtatacaggaacacgcggtctacgctgatcccttgtgacttatgaatggtgcaagctggtaatgcttttacattcaagaacatacgcttcatcgtccagaatgaatcccaatctggtttaaattttggattctctttcttcatttcgcgatattgtccggcgaccgtattcagatagatagagaaaatgttcttctgacgttgttctgtcagaatgttgatttctactaaatctggtttatctgtagtgattccgactgcatctaaacctactttctgatttaggatttctttgtcttcgtcatcatcgacgctttccactttcagagtatatcctaaaactggttgcggatctacccccgtgcaacgtaatgtaaattcacgcgggatgacctctttaactcggatcatctcaccattgttaaaaataacattgggaatcttcttcccgcgttcatctcgcagatattcgatcaatggttcctgagtaaccagaatttcatctacaatcactggttcatcggtgttataaacgcgcttacgtacaatttcattgagtttttcgacgctcttgttagtgtaggccagaatacggttttctagaaggtcttccggcgttttaacggtttcgaaataatgcttcataaactccggcagagttgagctatggaatacaccctcgttaccgcactgcttttcgaatacccatttaccattacggacagcggtcgccacatcaattattggcgcattagatcgtttaatttctgtcaactcaacgttttgaaaattttcatccgtgaagaaaggagagatcgacgttgcaccactcggatcaactggtcgcaactggtgcggatcgcccacggcaataataacaattcgaccgttgatactcttcatgagaatatcaaataacttcttatcgaccatactcgcttcatcaacaatgatgatctgaacatcatctagcttaggagtatctttttgctcaaatacttgagtatcttcatagttggtcgggttaagacgcaacaaagcatgtaaagtaaatgcttgacgacctaccgctttactcaaaacttttttagcctggtgggtaggtgttgccaaaaccacaccagttacaccacggcggaccatttcctgaacaatgaatttcatcattgcggttttaccagtacccgccgcaccccggacagttgtatgcttcttttgttcaatgcgtttcattagaacatcaaaagcatgtttttgcccgtctgttaacatatcgaaagttaatactctgctcattatcctaaaatcctcaccttgcgaacacagatagtattgagttctcgccgtacccgttctttttcatattcaggaattttatattcgataccatcccgaacaatttcagaagaccgaattataccaaattttcgtttaggcacaaccttgtatttcggttcacctgccaatagactctcacaataatctatctgatcacacattgacgctaacgcagcatcatgtgtttcgcaagttaggacgcgacccttcgcgtccactgagtattgaaagaatccgtctttatcacgataacatacagcaaatacatgcattataaacctaccttcgctttcatcaattcaatccacgacgcatcaatcggaagcccgtatttcacgcgttctttttgtgctggcgttaagttctcatacttagaaagagattcaatcaaaacgctggtatattttagcacgatttcggtattgtttgcaatagccttaagtttttcttctttcttgttgatttcgctaagggcttgcttgagatctgcaattttctgataacgttcttccatacgtaagagagtatttttaatcgctcgctcggctgcctctgctttctccggttcgttgtgctttttgtggcgctctattgctaatttcttttcttcgattgccatttcctgatttttgatgcgattctcgttaagttcgatccactcgatgtacttcgcacgtagggcaatttcatcatcagaaagtttacctttagttcctagttcctggatctctttaagagattcgatagtgtgattgccacggaaagaattgtatttcagtttaaccggaattacattgccatcaacatatcccagattgcaatcaatgcgctctaaggagagtccatcatcaccttcaccgaaagcctcaccggaataggcgcaatgagtctgacggtaaatgttacgcacagtgactaagctcatagagaagtctttgttgcgacgtgaagcaccagccatgatagagttcagccggaaaacaaccagcgccaattcttcgttagatttaaaagcaaacagtttcataattgattctccttagttggcatgtgtgtattattgtctatctggtttgtgctgtcaacacttaaattaaagaaaatttgtaaatctctatcagatcgccattacacgcgtaaacttcctcgatctcatcaaggatcatggtcgtccctgtcttgtatatgcactcgcgctcatctgccaacatagcatacaaagacagtcgagtagtcggattgtcatactctttagacaccactcggtcaatagcatgttcgtaataattcatgcaaggcttggtaggttttattgcaataatctttcctgttgcataaacatcggttgcaaagtcctctgctgttgattgcagtggcgtaaagctcataggacgctctacaacgaaagaatcgcctacaattaaggtatccagcttacggccttctcttttgctcacaccgcgatacaaggcttcatgatgcactaaccgctcagtcttttcaatcaatccattaaggatcgacatatcgatattttctttagagttcatcacctcatcaatgatgttaagttcttctggtgtaaattgcataataaaaaagcctccaatctttcgacggaggcataataaaaccattatagagtagtgtcaactaatttttagtagccgcgttcttgacgggcgaagttttcagcatttttcagatagtacagcttgaagatatccttagcggttaaacctaagcccagcattttaatcagcacaaaatgccagatatcgatcaattccatcgcaatttcggttttatcgtcatctgacaggtcagcaaatttacgcgatcgtgcttcgccgtggtttttcttccacactttagtaattgcgcttgcatctttgccatttgacatgccacccagggcaacataaagttctcgtgtctcgtcgtcgattgcgtcatcccataacttcatccagtcaaggatttctccacaagtttccagcttatcaggatgcggcacccactcaaatttatcagctagtgcgacctgtaatcctttttgcatatctaacattacttgcagtggatctttgccgctagtgattgcctcggaatacgcaataccagctttagacatagtttcatcattaacaagaccagcacaagaattaaattcactcataataaacctctcaaataacattaaacactgcaaattcaccgtgatacttatacgcatagtcattatagactattgcggcatctatttctaggtcaaattgtcctatataaactttatttccttcattgtcccttatctgggcgacccatttacccgaacgactattataatgcactcctttaaaattgctagttttagtttggttatttcttctcatattttgggtattctgtttttgtgtcgcctctcttaagtttggagggtcgttgttttctggattcccgtcaatatggtcaataacaggtgggcaatacccatgctctaagaagaatactattctatgcacaagctcaaaatattgttttccttcaaaagaaaacgagacttttaggtgtccggctgtgactttagatacctttactatatcaccaaccttataaaactggccttctttcgtcgttcggcttgctttgctgtttgttttatgaatcaatatacccctttcgtgtctatatcttcgacgtatttcatcctttagttcatcgctccattctttggctttccttaccctcacaatacaaccctcattaattaaaatttacaatatttcataaaccgcattttagccatcagaccttgtacggtgttctctttgatatattccatgatctggtcgcgtgtagcaccctcatcctgaatcatggcgttaacgtctttagaatgccacgggcaacggtcccacaaaacaatcttttcccctgcattgataaacttttccagtcggtgcatcgtatcggcagaccgtggttccgcatcaagtacaaacactcgctggtctgggaaagggatttcatctaatcccaaagtaccgccagtaattgcacacccgttatcaataaacaatgaatcgatcggaccttctaagaaatacactggtttactcggatcggcgcgttcaagaccatagaccttactcgctaactcatgagttttaatcgtcatatatttggtctttccgtaatcctttctcaatgctcgcccctgaatggattctatcttgttctcgcggttaaagataggaatcactaaacgcggttcaggttgtggattcttgaaagtatcagccttaatgtgatttgctaccttttgccattctctcgtgaaatacagaagatcccatttatcgtgaggaatacagcgatcactgacatactttattataggatgattagccggaagagtatctaacctctcgcagaaaggcaatgtttgcactttcttaatctccggcttttctacctttttcagtggcttgaacgtggtgttcttgtggtcgccttgttccttccgtctctccataagccattccctgaataggtccggcttatactgtttgagaaattcacctaacggctgattgtagttacagttgaaacaaccacaacgcaaactatccttataggtatagatacggaatcgcgcttgagtatgatttttctttgagtcaccgcagatcggacaactacagaccagcgtaaatgagctagtatgcaaccgtttaaaatttcgttcgccgtatatggctttttccgctatttcataatctgcgtagtaaatcataataacctcttatagctcaaatttcatgaaagttcctacactttcattttcattctctccgttttcatctaagccaaatttgtagacactgccatctggcgatgtgtaagagaatacacgaaaacggcctaccgaatcaagttctgtaaattcatattcttttccggcttcaaaaagtgcatatgtgcttttaagacatttcatcgtaatcatttaagcgccaccgacaacagaatgagaactacaccaacatacattgtgatctcggataacttttctgtttttgttttgtgtccagataatccgaaaacaacaacaccgataatagcggacagcaagccaacgataaacatgatgatactaagcaccgtctttctcctttttgcgtttttctttacccgctacactaggtccacgattggtaatagatccgctcgtttcacctgctgcgatcttctcaggattgccgccagcatcgccagcggtcatatcttctttgagtttattttcttcaacaaactgtttaaagccaatcatagaataatctctttcagtaagtcaacaatctggtctttcgtcagtttatcctgattctctacaatcttgataacacaagcgttaacatctttgcgagtcactcgggagatcgttttaatacgatgaaacggttcgtagaaatatactgcttcattatagagagcggatactttacgacgcatttgatctttatctgacaagaaaacaagtgctgttttatgaccttctacaccagccacgttatatagttcagcaacaccccagcgaccgtccggttcaatcattccggcgtgtttaccgtcgataaaaataagaatatctccgttgaatgcggttttgaatgctacatcttccggcgtaatcatatttttcatagtatagtctccttagagtttcattatagatcaatcgaatgtagaaagcaaatgttttgtttctttcagttgtcgttcaagatttttgcgtttctctttaagttgcattttagcattatttcgctctcttgtaacctctttatcaatgctcttattccagttatcaatatcagaataagttggcatacccaattctagacctaatgcggttggatacaaggtaacagtccataaaccgctaatcttcttaaataggtctgggtgtagtgtactatctacatcttccggtgtcaactctttttcttctttcagtggtgggatctcgtcatatggttccagtgcatttactttaatatcagatacctcatcaaagaatccgcgtacatccgcaggaaatacacaagcaatttcccaaccgtgatcacgcagagaagtaatatttttcactcccccaccatgtgtgatgattgatgtgacattgccatcaaggtccaccgaatttacgagaaatggcttatcgtctgtcagatcattataaaactgtgcttcggctgtagtcatctccagaaacagatctcggatcggacgaccatccggtgcgttaccttccttgagagtataaaagcgacttacgatccattttggcggtaaagcattagcgatcatgttatatctcctatcaaatcattcaccagcgccccgcagggcgcattttattagaaagtcatgttatttgctagctcgtcgagtttttctcgtttctcggcttgctgtgcgctttgtggtttaacttgtgcattctcctgatctgcgatctggtttggtacttcataccaacgctgatttcctttcttcacaccaacgttaaaccgtgaataatagttcttatcaccgtaacgagacttgatctgcttcatgagttggacgcccattttagccaggtcttcggtttcgataacacccaacataaagtcggcagtagccggaagacctgctgattcagcggtatcactcatgttaaggtcggaagcatcccaacccgcgcgggtagtctgtgccgcagtccaaccaacaacatcccacttaacaaaaaatcctcgcagttcttccgcaatcgccttaactagtgtgtaactattttcagagtatacacgcaagcgagacgatgcgcaaatacccagatagtcaacaatcacaacatcaggtttaaactgtttcttgagtcgcaattcattcattaacgcctcaaagtgattggagtttgcgccaccagtcggatactgcttgatcatcaattttccaaccggacgatctccgatcttcttattcttaacacgcttcatacgtgcggaatattccgcaaaagaaacattaccattatccaattcatctaatgtaatgtcaagcaagtttgcgtcaatacgtttggctacgacatgctctgccatctccattgagatatacaatacatcataaccacattccatataatccgcagcaagagaacacaagccaagcgatttaccaacgtttacaccagcaagcaacacatttagcgtttttctttccgcccctcctttcgtgattttattcaacatcggcagtttaaacgggatcttattcgccttagtctgatatagcaagaatcgtttttcaaagtcattaaaccagtcatgacctacatcagaatcaaacgtaatggatagtgcttcctgcatgatctcaggaatagcaccctcactcggcaatttcttattctgtttctcttttggtagttgtgcgttcgcctgaatctctagcgcccgtgacattgcattatacatagcgcggtcacgaataaatttttcggtttccttcattaaccaatcaaggtcttccggtgtattctcaagcgaatcaagaagagttttagccccttcatatgttgtctgattgcctctctccttgtctaaagcaatctgtaatgcagttggcgtaggaatattggaatattcgtctacgtgctttttaatcagcttataaatcagtttttcttcgtcttcggtgaagtagtccgctttaaggtgaggccatacattcgtaaagaattcgccattgtaaatcaactgtgaaaagatagttttaatcatacatagcccccaactacacgcataacaaaggtcttgagtttataccagaaagtttcttttttcaacttttcttctgcttctttgatctgcgcggttaacgccttaatgacgtgtggatataccacatcacgatctgacggcgtggagtagtcgaccacaatacctttagtgtctggatcgtattcaacattatgaatatagacaatatgatgctctccctcttcatcaacaattatcaattcctgaataactgtcttcattgcttcttgaatcaagccgtgtgcttcttctaaacttgttggtttcttatccataatataatcctctctagatatgaaaaaggggcacgtagcccctttactaccattgttatgataacatatcttcgatttctttgtcaactgcttcgtcgctgatcacttgccccagcttataatgatcgttgattgcttcgttaaacttatcgtttgtcagaagtggtttccagaactcaatgctattggtttctttagcacggaacttgcgttcttcggtttccatctctccggtctcagtattcaggattgaacgagaataccagccgtttgacggtttcactacccagcctaactctacagccaactccagcaaaccggaataaggatcgatgcccccgctaaatgttacgctaatcgggaacttagatttttctttaacggttcgtgatttttccgcattcaggataaaatcataaccagtaatttcggttccttctttctgttgacgacgaccaataatgaaaacttcattggctgaatacatcgcgccagtaccgccggacataacggtcttactaaacatttcttgcgtttcgtaagtgtggttaatagcgatgcacgggatatcattcatagtcagatacggtgtcaccatacggaacaagcctttaagtgctttagctcgcgtcatatcctgtgcggatttctcattaatcgcgtcttcaacttcttttttacttgctaagttaccgattgagtcaataaagatgatcactttatcttcacgggtaatttgctcaagctggttcatgatttcaaatttaagttcttcgatgttcttgattggaacatgcaccacgcgatcaggatctacacccatagattcaagataagcgggtgtaataccgaactcagaatcaaagaacaaacacgccgcatcaggattctgtttcatgtatgcactaacacaagttaatcccatgtttgatttaaagtgcttagacggaccagcaaagaaaatcagaccagattgaaagccctttttaagatcacctgaaaacgcaatattcagcatcgggatcttagtgcgagtatttgttttttcgttaaagaagctggatttagacagtaccgcagtagttttcagggtagagttctttttcagtttttccagtacagacattattaatacctctattcagttaatccgtaatactttaattgcttcattgttattcgatctttgtagtgctcttgaattaactttttcatcgcatcaacatcgatcgtcacaaatacttcgttgctgtgatttccgtgaactttcttgaaatgctctatgccttcctcacgttcacgtttaatcttttcaatgtctctcataatatatttctcacatcggcgggtatcgtaacccaacacccgccattatacacactttatcttaaatgtcaaacaggtccgtaagcgatgccaccttttcatattgcagctttgcagccgtggtaatgttctccagtggtttgacaaaagtcttattaaacaacaaaggccagtctaaccactttaacacctcgctttcaatttctggaggaatacgagtaccggacaaccaaccaaaacagatttctccaaacggatttcgatctttaagcggtacaatcataaccttctcgccctcacgaatcggatctagtccaaattttcgagcattacgattataacacaatacactcttaaccgcatacggacaacccttaatcggatacccgtttgaatcgctgtatttctgtaggttgtttgcagatgataccgcagcaacctcaagatagtcaagttttctaaactcttgctcaaaaataccgtagtattcctgtagcgattcttccccttcctgcaacatacggcgaatacattctttcagtgatttctgacatgctttaggggtagagctacgttgcgtttccaagcccatgatttttagcttaggttcagcaaatcgcgttccttccatatcccaaacattaagagcataacgctttttaccagtccagaatccaccgatacccgcagatttcaacggaggaccagcaattgcttcacggtccataaacatcaagtgctcatagttgttcatgtactcgcataactcgcgatatcccttgtcgataataggttccattcgatgtttaccgaaattatcaaggaagtcaacaagtttttcggtatcgtcgaaacggtcttccccgccaaccttatcaacaacattgttaaccagcacataaacggagtcagtatcacaataacgaacatatgcaaaatcggttgttccgcaaagctcgtttaagtattcgttaatcttacgctcaatccactgaattgcaagctgaccgaacagtgtgatcgcactagcgttacggagatcataaaaacggaatttaggattccccaacgcaccataaagggagttgatcaaaacttttcgagaaagctggtttgtattgcacaagatcgactcgtctttacattcttccagcaatttctctaaggtatctttgcttaattcagaaagcatcgatttaaacgcttcatcgaagtcgtgacgcacttcaacgctatagctaatggttcccccataaacatgattttcatcgtgtagaatcgctttacatagttcagcattgcgatcacatgccaacatcatgtttttgtactgcttacgctgatcgaatacctttttaatctcaatcggtacgataccatgaatatcttttctatacatccatccgttaggcgagcaagaatactcatcactcggacgtggtgcagttttattgatatactcgtgcatcggtgcagcgtcaaaagatccggcgattgtttcaggcgaaatattaacctgtcgaataatagatggatacagacttgttaagtcaaagctcatcatccaacggtaagcattaggtactggctcttttacaaatgcgcccggataagtctgcttaggctgtatcttgttctccggtactactttaccctcagctttcagagatccgaaaataatagcatcccatactttcatcgggttataaacatggttaaatttaatctttgcatagaaacatagactatacacaagatcgataaatccacgctttttatcaatcgccagcacacgatcaacgtcgccgatgttataatcgatgtaaagttgatggttatcatcacgcaatttctttaacggaccatcataatcaaccttaccgattcctgtctcatattcagcaacataatctaacgcatatgttggttgagtagtaaagctaaatttcttgtacaggtcaatataatcaaggctttcgatccccatgatcgtaaatgcttcacgctcgttgccaaaatcatcctgtgagattcgggatttaatcttaccgcacgggcttagacggttagcggttctacttccgaacttattactgatacgtttaatgatatatggaatatcgaatgtttctgtgttccagccagtgaaaccaacgggtcggttttcctcaaagaatcggatgtattctaacagcaattcatcttctgtgtcatagacgttataaacaacacgctctacaatatcaggtcgaagaatagacttttttgcttcccagatttcaccgttttttcctttcaaatcaaatacaaagaaacgatcatgtacggaatcataatgcgtaattgcatcgataggatatttcgcttcttctggtttaggaaattctggggcagtgacctcaatatcaacccatgctacacggattttatttcggtcatatcgaatctcgcctttatatgtatcggacagataggagatgataaaatcatccatccctagtgcctcctgccccatttctcccatctttttacgccatttgttggcctcgttcatagatgggaattttttagcaatgcaaggcttgccatagatatctttataattcgtaaccataccaggcgcggcatgatgaaataaagttggcgtatattcaacgtaacgctcttgttcttgtccagcatcatcaatataacgctcgtagatcttatcacccactcgctcacatgacagaaaatacataatataaactccttcacttacgaaagacactcattataggggaatcgacttagtttgtcaatacccctatcccatcagtatcttagcgtccgatctgatatttctcgatcagcgtccactcttctttctgtttgaaagacagtacacggaaattattaacttcggtagtttcaaaatcactatcaatcagggtacacagattccactgcgccagaagttttgcaatgttattacggcgtaattcatcttcccacgtcattttaacactacgaccatctaatttcaacaactccttgaaatgaacgatgtaatagcgccctttcttctggagaatatgacaagactgatacagtgtcttgtctcgattgttggcaatgccgcagcgggttaaagtttccttaattttaaggaagttttcaggactaatcaaattaatttcaatcattttaccacctttctataatctttttaagtcgtttcctttctgtctgattcttagtaacacccgccaaaagttcatcggtcgcatacggtttaatgtgcttcaataacttgtccatatatcccttttcattagccaaatcgagataaaaccgggcgtcatccatatttacacaatatgctttcgccactgccattaaaaccaatttttggtccaattcttctgttagtttagcccatttaccgtatcgtttccccttagaaatactctgtaagagataatcaaaatgcatttgatctgggaggtcatgaccgattaaattcatcacatacgcgctatataggcaatctgcgtgctgggaaagagcggtattaatccatctctgattgtatgcagaattattcccaacattcacgcgctgtttatctaaggtgatatgatccatcagagcaaataatgcattgtcggttttctcggtgaatgtatccgctaattcagacaccttttcccaatcacgagagcgccatgcaatttcatgctcgtttaattgtgtatcatcttcaccgaaaaattgacctaacattatacgaactccaattcaaccattaattgcattaacaaaaagacaatgtgaatctctttatcagccgcgtgtgcaaacatctgattattttcaccgataatctcggtcagacggataatcgacgctggcttaacttgagtatacaactcattataaagtttcttgacaaattgagcgtatgtattggtatatcgcggtgcaagtttacgcacattagcaaactgtttagttttaagtgcttccaccacatcggttacttcggtattgctactttcgataaccatgctcaatacgccagcatcaattttaccatgtttagcgtagcggtccaaaagtttcattacgcgtcggaagtctgggaagttctgcttaaccagttccgctaatacgcgcatttcttctactggcacaccttctttatcaagaattgctttacaccggacgatcatttctttcatcatgcgaagctgatcatctttggtcggagatccaaacgtgatggggtcaaatcgagatcgcaacgctgggataataccttctagatcgtttgctgtgataatgaatgtcacgttgtttgagtatgcctcagagaaactacgcaggtgtctttgagcgtcagctaaccccgctcggtcatactcatcgataataacaactttgcctttttctcttttttcttcatcgagtgatacactctgcgcaaagcgtgtaatctcatcgcggataaaatcaatcttacaatctgcgccgttaacaaacagataatcaacacccacatcttcgcaaagcgccttagcaacggttgttttaccagtacccggcgatgggctatgcaggatcatagaagggattcggccttgcttaacaatctgcgcgaagatctttttatctgcttccggcagaatacattcagaaattgatttcggacgatatttctgttcccactgaaactcattttcattaacactcagcatataatcacctctcacaaattacatcattaaaacggggagtataaatactccccacaaacattatattagtcggtgtagctggagtcaaggtcacacgcgatcatataagatacggtttcacttgccagccatacagccttacggcgagtgaagctcagtttgtaatcgccgaagtcagtagcaaccagtttcatgttatctttacgaataaagaaatggaagtcggcggttccggcatattcgcccatgtcaagacaaaacatctcattaggattatttttgtcaatctcttcccaacctttgatcatcagacgaccatcaatcggaagaaattcaaggcggtccactttaagctgattgctcattttcataagctgtttcagatcgtcgttgctcagttcgtaatctacatcgcttgcaggtggagtaactcggcctttcggtgatacgatggcggcagcactagcaccaggataattaattttcagacgatcgttagacacacgaatgttaccagtgcggttatcaaccgtaatatctgcttcatcgcctaccagattcagaatacccaagaaagagttaagatcatagatcccaatttcgtgttccagttcttgattcagagtcgcttcaccatatacaacgtttgtcatgtttttggtgatcaggacgtttccttttttcaggatgatacctgggttaatagcggaaaagtttttcagggtagcaatggtttctttagtcagtttcatcaaatcacctttatcatgttaatcaattaattatgggtttactgcgtgttcgttacgaatcttgagcattttgttttggaagttttccgcagcttgctcatcaatagcatgagtatacttaaatccaatgtatgctgtcaagtattgttgcagagcatagacagtaacaggattctttgcggtcttcttgccttcgagatatatcagatcaccacgaacatcaaacgcaagtttacgacgaatcacattatcaacaaactcatcaacaacaaaatgccaaatgttgctatcggttccaatatcaaaattaatcacacatccttgtttgacataatcaaacggtatcgggaatagtttatagtcaagttcgataaacattaattgttcttttaagctcatacgtttcattctatcacttcccatcagcaattgcgatcagacgagttactactacgctagcggcttcaatcagcagttcatcagtgtcaatctgataacccttttcgagaatatctttaccacgaatggttttagctactttagcaattgaatcctcgtaatacttgcgcattgccgcgatccattctttttgcaccatatcatcaatatgcgcgtatagttcaaagcgtgcttgctgcgggataaccttcattttagctttctcgctttccggcatttgtagtacccacgctttacggatcttgttcattgctcggtcaaattcgaggctggttttcttgttctgaatgtctgctacagtaattttagccaggtttgcggaagtagtcataatattaatctccaaaaataaaatcagtatatcacgttctaaagtttgttgcaaccccagcatcagggtaatcaagtttatctaagttggggaccagcataaactcatgatgacgacaagacaacatttttgttatgtcttcatcgctgtatatgctgtttttcatatcccccatactaactacatattcttcaccggaatatagattgattaaggtatacaattctaattccggctgcgttactctgtcaaatgttaacattcatttcagtgaatcgcccacgtttaaccatcttgagatgacggctaaaatcatcagggttatggtcacgatggctgataatatacacgttatcatctaacttgtcaatgatggaatcaagtgcttttacgccttgaacgtccgtagccccatcataaatttcgtcgagtaccaacaaagaaatattagtaccagatactttaccagcaacatcacgccatgtaaagagcatcgcaaggtcaatacgtgctttttcgccttgactgaatgatgtatacgaaaacgattcacgcccccgtgatttgattgtttcgttaaactcttcatctagcgtaaagatataatccgcttccataatatcaagataatacgcaatccgatcattgaaatatggaatatatttcttgacgatagacgccttaacaccggaatccttcaacatttctgttacaaatccacggtgatatttttcaagaactagctttgatttttcattagtaatctctaccagttcgtgttccagtttagcaagttcttcggaattgtcaaccctttctttttgtaattcctgaattgctttctggatctgtttagcccgacctacagatgccgttaaattcgctctctgtgactctatagcgcgtttaatttccaagaccttagtttgtgctgtctggaaagaattggccttctccgcgtattctacgcgtttctcgtcaatcagagacagtttatgttctgcttgtgctttttgttcgcgtacagcctgatcattaccctgaatgatcggttgtgtgcacgtaggacagatcccgcctttctcgtgcatatggataacacggtcaaagttctggatctgcgcaccaatctgtgcgatagcagtattaattttagccaatgctgcgctaggatcttccggtatagcaacagccaatagctcatcggtcaagcgcgtttcttcggctttaaatgctttagccgattctacctctttatcatacatattctgtaaacgctggagattctcggcacttgccttgctagcgtcttctatgtactttttatgagtgttgatttgttgctgaacgtgattagctttcatttcctgcatttggatattctgggttatctcgcgcacatacgctttattcagtttatccatttcgcctagcgtagcaatatcaagcaaatcctcaaccagtttacggcgacccgctgccggaagactcataaacggaacataaccagcagtgcctaaaacaacgatctgtttgaagctggctagattcatgcctatgataccttcaaaatattcctgaaagtctttggtgcttgcgctctcgtcgatcttttgaccgtcgcgatgcacttcgaatacttccggcttttgaccacgtttgatataaaactctttcccgtccagttcaaaccagacttcgactaacagtttctttttgttgacgctgttaatcaattggcctttcttgatactacgaaacggtttaccgaacaacacaaagcaaagcgcctcgatcattgttgatttaccagcaccgttaacaccagtgattagtgtctttttgaatccgtctagctgaatctcaacaggttcagcacccacgctcattatattttgatagcgcaaggttttaaaatttaactttgccattaatccactccgcaatcacacattccataatattaaatgctaacacatcttcatcgatgttgtaaacacttgccgccttcactttaactaatgtgtctctgcgatctggcaacatgatcacataatccagtgtcgcaggatcatatgtcataaatggatcaacataaatccctttattcaatgccagatattcgcgaagaccttctataaccctgtgtctaaggtaggtcatcgatagaatcattttagtttatgttcctctaaaaattcttcaatttcaccttgcaggtcttccgcttgttgttccagaatatcgcgaaattcacctacagtcaagcgataatcacacttcaccagtcgatgcgggagaatataccctttatacatcgtctctgacgcttccaggaataccccgctatgcataacagagatccaccctgttagcgtcaatggagtattcggaaaataatacttgctggattgtttccactggacgaaagcaccatacacaatcggattatattcaccgaccacactcttaataatggcttctactttgtcttttacaaatacgccaatgtccatagttaccatcaaatcctgtggatgaatcactttaaggtaacgacgataaccgtcatcataccacatcttaaccactggctgaccccacattttagcaatacgcgctttcagatagccatagatcggattcttgcaatgtgattgttttagtgtgtatgtgtgcaccaattcaataaaatgttccattaccagcgaatcagaatcagccgcgaccatagtcgtattcataatatgttcctcgttcaatttcatattgtttcaggtcttctaaaagttcatccactgcttgtttcagcacatgacgtagcgtaaaataatagctttcatcaaattctatttccgcgcgaggaatagagcgaaacttacacttaacggtagtatcagtgagtcgcttttcgaccatcatccgaacttcttcatgctctttggaataccatacatcaacggagatccccttgcgtcgagcaaacataggcaacgctgcattaaattccattactttttgtgcaagtgttttcatcgtacagaccccatagatccacgcgcaataacattctgggtaatatcagcaaccttacgggatatgatgtttgttagcccctctttggtgatattttcacgatcaaatgggatttcgtcatgagtccataaaccatagttagaccgaaatgatagcatatactgaccatctcgcacaacctcaaatacatggatcttagtgaatttcgacaaaccttcgttgatttctttcagtgcattagtaatcataacaacctccaatcaattttttagagagtataacggggatttctccccgcgtcaactaactttttgcgttatttacttcggctaaaagttcatcagaaatacgcttgaccgccgcaagttcttccggttctaggttttgttcttccagatattcatagaccatctgaatagtgcttttaacttcaataacacctgtttcctgtgatgcgctactctccagtttatggaccacttttagcttgtgtacaacggcctctaacgcgctttctaacttagttaatccattatcagcgaccgttgcgataagacgcacactaagccccttaaagcgttctacatcgattttatcatctgacgggtaagtgatacgcacatgataagttttgtcattctggataaactcttttttgtgtgtatcggtatcgaatacccaaaaaccacgcggatcgttttcgtcaccagccgttagtgtgtatggtgtaccaatatacgttacgttaccgccatcgctgatagtatgaaaatgaccagaaaacacttcacggtatttcttgaggaagtccgcgctataaccttcggattttagccctttatagaaatagtaaccggacaattcccaatggcctacacaatattcgctgaatgagttttgaataaactctaaaatctctgatttattgtcatcacaaaaccacgggaacagatcaaatgatacaccatcaaaggtaactgtttccggtttatcgataaccttaatgcaatcatactggcttaacacttcacgcggtgcgttaggctggatcttgtttcgtttaaacatatcatgattcccgaccgtggtataacaagtaatatcagcctcttccagtaacgggatgaccttagtacggttaaatttcatggtttcatgggtaattgcttttcggcaatcaaaccaatcccctgtttgaatccatgtcttaatattatgctctttggagtattcaaccgctttcttgatggtatcaagaatatactcatgcacccacggatcatcgccaccgataccagtatgcagatcacctaaaagcaaaattttcatagtctcttcctctcttcgttttcgatgctctcactatatcacagaaaaataaaaagggaaacccctttcagagtctcccttataaagccattacagcatacttaataccgtttgccgtgtactaatccacatagcagaaagcagttctggcgtgtgtggctgtttgtagatatcacgtaattttccgatagcgtagatatacgcatcacgattatcatcgatgatagcttgttcagcccaccgcttaaggcgcgcaatctctcgcgagttcttacgcaagatcttttccgctttcttagcggctttagcctctagttctgcttgtactttgtctacttcattcactgcaatctggtcatgctgttcatcgtaagtcatgttattttacctctgggatataatcaattattaaagaaaattcatcttctgatacattatagctatgtgagattgtacccgtaaagacctcaagatccggtgatttgatattgcacggatcgataatcaccggaacgccgcaatctctcaaaaataatttggcgaaatacggcacgaggtcagtttcaaactctgcttcttccagcaaacgggaaatgttaattttcaatctcataaaattggtccaggctaggcaattcctcagtcaatacatcttcaacctttggcgctttcggtttattgaccgattcctcgtagttgttgattttatcgtaaatgtcctgtatgaatgcctcatcagcaatctggcacatatcagcgtcgcgttcgtcatatacatgatgcacaaaatatttgtattttgcggctgtcgctgttctctcttttttaatgcgctgtacaaaagcattaaagcacgcttgcgtgatgtaagcatgaggatttttatactttgtctcgtcaaaattaatcaaacccttgaccgccgcttcgattccgtcgtcgatcatttcttcgcgccatgtttgactataaccagaaaagttaaaacgacgtgatagatttttagagatttgcataattgctaggccgatttgatcgctcattggaacttgccgaccttctgctgcaattcgttgtttccaacggcaaatttcttcgtaaagctctttattgtttacataatcagacacttcgcaccctcgctattatttaggaaataaccctttctggctattccccattaccattatactttctttgcttagttatccacactctaaccatctctactgattcaccgtcagacggatcaagagtttttccctttttcttcatgcggtacttaaatccgttaaatcttgcattctcttgttcgttaaagtcgaacatctttttaaatgattttctccctttacgctcaccacattctagcggaatcattcggtctgttattacattggcattaggtagaaacgtttttagataatccaccaacgcccaatcaggaacatatagattaacattctccttgctctcgttgtctctcaggttacaacgcaaacataattgaaatgctggttccagataatcagacacatgacgcgctttcaaaaactcgtttgtcgggagatcacaactattagcaagaccttttaaaatatcaatctcccatcgttgagggttaaagctgaacatcacagcaacatttttatgatgaatgtaagagttaagaccataagatccgtaaggtatccgctcaccaataccatttgtgcacgcttcacggtcccgattcacggtataaatgaagtcatcaccacattcatttttaaccatatcaacaagacgttcaaaggtattgtttgtttctgactggtgacgcgaccagcgttcggagtccgtcataaggatgatgttaactctatctgtatttttatactctttgaaatatagtctggattctagcgcactcggaacaaaatcgcaatttgcatagtatcgtagatacttcccactatatgtatcaaagagatttgcacatgctatcgtaacctttttaaagtctccccacgtaccgtgtttgttatcgttcaagaaaacaattttcgacccattcttccggtgtccttcgttatgttttaccataacgttgattttcttctctaataacgcctcataaagccctctaagagaagaatcgatcatatcagtaccatcctttgcactttctatcttttctttgatagcggccttctcagagtcttttagaactaagttctgtaggcattccgattcgtcggcgattggttcgcaatgcttcgtgataagttcaagattagacttaaacggatactcattaaattcaaccagttgaggaacttcatcaatgtaaagagcatattcaccaaacatttttgaacgttccatattagataacgctgtatgtgtaatgaatatcacatcagcaccgtctttaactgattgcattatcgacgcttgcactgtcttaaggcttcttagtcttgtgctatcaatcaagacagcacgaccgcccattcttttaaacttattgtaagattgttcacttaaaacacgagatggcgaagcaataaccgctttttcttttgtctctaggacgtgggaaagtatagcatcagttttccccgccgctggcaatgcgattaatgtttcaatcttcattagaaacccttacgtcgtgctttctggcatttcttgatcattttatcagaaatttcgcgcttaggtgcaatctctttcacaccgaaagcactaatgccaaattcagagagaatatattcaactaacaattcacgcacacgcgctttaccgatattcacgccgttatttttcagatatgtctggccttcgacttgcatcagatctaaatctgcgtcggtaatattgatttcttccatgcgcccaaatcgagaataaaccatgtgtgcgattgcattgtgtactaacataatatattcctcactcaagaattacttaatgatacttactttaccagatccgtgacaatgagcacaacacccatcaccacgcaatcctgttccgttacagtgtttacacttcttcaacggtaaagtcattatagcaaataaagcaataatgaacaccgaaactaaattctcaataatcataaatcgccctcagttctttatagcctccaatgtgctcgttgtcaatgaatatctgggggtatacaaaccggaggctctttgagtttagcctccccgccagttcttcaatcatatcacggtcgggaataatgtcaaccccgacctgcttgaatactggtttaagtgtatacggaatacccagatcatccagtagcttcattgcactaatacaaccataacaatgataagcctctttcggtataccgtatatctcgatcatttctcagcctttaatctttctagttcttcttccagttccttgatccgttggtcacgttcaaagtcacgctgtaacttagtggcgaatactcgtttaaactgattgtaatcatcgattttaaacacttcttcttcgccatagcgacgcacagaaacttcgtagttattgaagaattgttgcatcattgcttcggatgatagctctgctgataccactttaaaatattgatcctctgtaggcgaaaaccaattacaagcataaagataaaccttttcattgtctggacactggtaagccttaccatcgatttcaatcacagaaacatattcaggtatagtagatgaatcaatagctaagactttaaacgcacggtccccgataaactcggagatcacacgattcgcatcactggttgcaaatgctttacgcgcttgttcgtttttccactgataggtcataccaacaacaaacatattaccaacctcgctctttaccaatcaaaaattcaacttcacgacgtttaatgtcttcttgaaggtctttaatcttctggcgatcttgcatgatttcatccatcttgtcaagtgccgcaatgaaatcatcgaaacgttcaaaggttttaccttcatttgcttcgccaaatttaaccattgtcaggccgtaacgactactaaacagacgtttcaactgtccaacgatcttagaatcagtggttataacttccaattcttctacttcacgaaagaattttctatcagaatcaataaaccagctagttcctttatggtctctatcttcggttgcgctcattagagtatggtctttaccatcaatttcaattacatcaatttgcccacatggactaacatttttaacagtaaaaggtctataatttattgctcgtgcaataacataattaaggttagatacgttttcagcataatggcagaagtcggtcatagcattcgcatctttccaagtataagttttaccaacttcccatttctggggaacttcttcaacttcacgaaagaattttctatcgaatggactaaagaaatatgttgcagtccaaatgtcttttcctgtagcagttttcgccgtatgataaacaccgtctagctctattacattaatccaaccattaccttcgatctcgatgatggtaaatggcttgtcaccaatagctgcactaatatcgctgttaagtggagaaagaacaccttctccgttagtaataaactcagttttagcgttttcgtctttccaggtgtaagttttaccaatttcccatttcataatatattccccttaaccgattttatcaagttcgtttaatgctttctctgcttcctgtatagcttgcaccctttccggcattttgtcaagaaaatctttcaactcttcaaaactggagatatgacgcaaggcgttagcaccgatagccgcatgtgatttgcattcaaagcggattttataattatccatcgccaacttgagaagatcaattaatttagattcttctggaataataatttcttcaaatctgctacggtcatgatccagaaaccaacaagatagacctacatcggttgaactcatataagttccatcatgaagataaacagaccgcacgtatccttttttcgcatcaaccgacgcaactttaaacggtaatcgcagatatttcaaataatcaacatcataccatttaaaaaattggtttgcatcttttacatctttccacgcataggtcttaccagcttcccatttcataatatcatctctcatttttgatacgtgattctaattggatcatacggtcgcgcgtttgtttgtattctcggatagcaccgatccggctaggcataccatccagtacgctcttaataccttctagggtagtaattttggcaatgctattatgtaaccccatcttatcgatcaactgaatgtcgtaggcttccataagcagacccaggcgttctaaagttaggtcttctttttcttccgaatctggaatcttaggttcaatagtaacttcggtaaagaaacgacgctcacccgaccaaaaccacacaccggaacagccaataggggattcttttaacgtcatagagtcgaaattactaccaataatagtaatttctctaacatcaccatcatcgtcaaggtcttctaccctaaacgggcgaccagccaacaagtcaacaatacatatgttaatagacgacgaaaatttagtcagttcggctttcgacgcttcgcattcgatcttgtaagttttaccaacttcccattccataataatcacctcaaataattttcactggaatactattaacaatcttgtattgtacttgattgtccgacccccgccacggcttcttcgttggcatatctttaatataacgaccatcgatgaacatgtcaactgattctacaatttttctttgctcatcattcaattggtcaagggtataaccagaccatagccaaatatctttatttggcatccatgattttacttcatcaatgatccgctgtacaccctttaaattgcgtttatacagtggatcgccacctaagaatgttagcccctgaataaaatcaggtctaagcagatccagaattaatcccattgtatcatcggtgaatggttccccgttcttaggattgagtaggctagcattaaagcaaccatcacatgcgtgtgaacatccggtaacgtaaagggagactctcactccctcaccgttaaccatatcacaatctttaatatcggcatagcgtagtttgccgtatgtatcagaactcatattcaattaccccgaactcgtttacaatctgcgctttatagtaaccaccgcgagatgccaatagataagctgggcttaggtattcgtattcacggatttctacttgtgcgttttcagtttcccaaatcagtaaagtccacatatttgattctcctgtaaagttgtatctcgtcttgatgaatatagtataggggatctcgcgatccccgtcaagcatttattttaaattttttcgaatgtattcagaccattccttccctgtcatttcggacccattctggaaactgaaatattcatacggcatcgagtcaagataaaacaggatcatacatcgcgccatataataccaatcacgattaaagtaaactacgttatcgccagtaccatcagcacctttatcataaccatcgcgggtacgggcgacccattgaatggtatcatttttctcacggatagtaacaggttcccaatatccagcacatccagcatgaccacacgaacaagtaaggaaatattgaccttttgctttgttgtcatcccattcacgatgaattggttcgatttcgtgaaacagtgctaagcaatcatgattatgcaacactggctcaccatcaatcaatgcatggaatgtatacaaacgacccgtagacaaatagctatcctcacgctcaaccagttcaatagcaatctttttagctcgttctttgtgtcgttgtgctttacgtttacggtttaatgatttcatagtcacctcacattatttcaaagatcgcgatattgtacattatgaaaatgagaacttgcattaccaatattgtagataacaaattcttcatccggcgcttgcgctacaaattgagtatgagcaaccgctacgactttaaaaatacgatccgtgatcttgtgtttaatttcgactcctacttccataggaacatattcatgtgtttctgtttcagtcgcaaaacagccatcttcttcataagcacgaacaaatcgatcgcaatcagtacgcttaacaaattcaagagtatacaattctcgtgaattgtcggtatagaccaatacagaattattatgatagcgaatcacatacaggttattatcatcgtcaattacgcaaaagctacggattccttcgcctttactccagcagatattaaccaccgttcctctaataaaaaaactttcctttaaattaaaactagtcaatgtgctagcgtgcattttaacaacaacaccatcgccaatttccagtttacgaagtttaacttctttgctcagtacacaaaacatcatcatgttgtcctctcgttgttttcgatgtgagcattatacacgagctaatccggttgtcaacaccccaaaacgaaaaagccgaccctttcggatcggctgaaaattacatgtgcttaacgcggtttaccatctcggagtgtttcccgtggttaaatggacgcagatcaacagatccaagatatccactaacgcggcggataacattcatcttttccagattgtcattgccgcaatcaggacaaacaaagccagactcggtcgctctcatttccttagtagacccgcatacatgacatacatcagaaggagtattaacaccgaagtagtgcaatttatccattgcatagtctactacagtttcaagccctttaatgttgtttttcatgtctgggaactcaacataagagatcataccaccggacgccagccagtgataatctttctcaaagtcgattttctcaaatggagtgactttccggtctacgtcaaggtggaatgagttggtgtaccagtctttatcggtagcacccttaacaataccaaattgctctcgatccagtcgattaaatcgatagcaaaggctctcggctggcgtaccgtaaagactaaacccaagtccggtttcatccttccatttttcagtataatgacgcaagatcttaagaatatgtttaccgtatcgctgcgcatcttccaaatcaaacggatgaacaccaaacaggacgctcaatacctcatgtaaaccaatatatccaagagagatactagcgcgaccatctttcagaacttccaaaatttcatcgttttgatgaatacggaaaaatgcaccttctgtatacagtacaggagcaacattggctttagccccttttaaagcgtctacgcgactcatgagcgcatcaaagcaaataggcatacgattagctagctcttgttcgaatagctcaattctgcgcattacagacgctttaccagcacgacgagcggcaataagggcaatacgcggaagattcagagtcacaacacctaagttattacgtccgtctaatacttcttcgcctttctcattatgccacacacccaggaagctacgacaacccatcgggctaaccggaacactagatccggtgatactacggttattcttcgcagagatataatcagggtaaagacgcttactagaacattccaatgcaagttgcttaatgtcgtagttcggatcttccggtttaaggtttaatccttcttctaagaacatcaccagcttaggaaacaccggagttataccatctttacctaaacctttagttcgaactttcaggatcgctttctgaatcagtttttcttcccagctagtaccaataccaaaggttaaagtcacaaaaggtgtttgaccgttggtggagaacaaagtgttgatttcatattccaacgcttgatacccgtctaaagtttctttttctgtcttctcttgtgcatagagagtatcagctttgattccgtaggtttcggcatcagtaaggtgtttatgatatgttttctcaacgtatggcgctaaaacctgatcgatgtttgcaattgtggtccctccatattgatgactcgccacctgtgcgataatttgagcggttacagcacaagcaacgccgattgatttcggactttcgatttgtgcgctacccaatttaaaaccattctctaacatgtctttgagattaacaagacagcagttagtaaacggcatagcgggtgcataatccatatcatgataatgaatgtcaccgtctacatgcgctttatagatgtgctcaggtaacacggttttagcaatctgtttagacacagcaccagcaatcagatctcgacgtgtcgggaatgttcgcgcgtctttgttcgcgttctctttgcttacttcgttttctttacccgttgcgatctctgtaatgtctttgattagtttttccattgtatcacctatgaaaaagcgggattttctcccgctcgttgatagttattttaccagttctgctaattctttttctttagcttctagttcagctttaagctgtttaatctcttgtcgcttcttattagcggcttcctgcttactatttcggataacctgatctagatacaactcccaatcctgaatatttttgataatgtatccgtcaacattaattggtcggagattcagcacagcttccagtttagttgcaaaaactttaattgctggggtgaagtattcatattcgttatcttcaaaccaataacctagacttgcattatcaatacgaagacgaagttcaagatcaaggtctttatcttcggtgtataggtcttttacacaccccatagaattaacaacaactttaaaacgaattttatctacaccaccaaacacatcagtaaggataccagcaattgagctattagcgcaagattggtcgctgaatgcgtcaaggttttctttagttacagtataccaaacatcttgtacccacataatataatcctctcgttgttaagtgggagtattatagcatactcccttcgcatgtcaagcactaacttttttctttactgctttcaccttctggcgaattgctcgaatctcttcgatctctttttcagtctctttaacaatttctttgcgattctgaatatctgtatcgagattatcatcaagtttaggcagcatgtcaatcaagaactttttaaagtctttcaggtttcgaataacagcaccttcgcccattaccgcaacacccacaccatccggcagatcaccaaacagcttaaccagttcagacagatgatcatgatcttctagtgcttcttccggttcagatggcagttcaacaaagttataacgttcatcattgctgatcaagtgataccagcaaagcccgaaagatttcggtgtatattctacaccatcaatttcaaccgcgtcaacacttccataatcatctactttagttaccttaaatccttgtcccagcttttgaacaatttcaacaacatgacttgatacagtttcagcggtaaaccaatatggcaaattatgctgatttggcttgtagcgttcacctactttaaatctctgaccatccgcttgcatagcatgaaattgttgtttcgtgatttccgcgaagtattcaaattcgctaccgtcaaacaagcaattccattgatcacaaaaacgatctgccttaacagtttcacctttcgcggtgatcattgtagctgatccgtgaaattcttcttcaactaaaaagccatattcgacaaaatcaacaagtttcatagcttctttgtgatctggatcatgctctccccagaatcgcttaaattcttgcaaaccttctggggtaaacgaataacatttacctttttcaaagtaagtcggcattgcatcctctttcttgttcatcgcttcgtatgcctcttttgagatacgtttaaagaatttacgctcatcgtgcataatcatagtagcccaataataaacgatatcctcagcggaataaactacatctccagcttcaatagtaataacatgaccgtggtcatctttttctaatactttaaagcccttttctacgatttcagcaacccgaatatgaccacggcgcgaagcatcggtcagaataattgaatagcgagaaaagtctagaaactcatctttaccaccttcacggaatgcatagtaatgaccttcaaagaatttagccataatataatcctctcgttgtttaaatgggagtatcttactactcccgtttcatcatgtcaagcgttaaatgacttttggatctctttcagttcagctactttatcggcgctgaatttagcgtaggtatcatgtcgaataatttcactttcaagaaaggtttccagccgagatctattttcaataaggaactctttcaggtcttccgcgttcttgataaagattttattgtcagtaatgtcatcttcaatcgcaaaggagatagagcgaactttaccaaacaagttaatcagatcttccagagattcttctttcttaactggtttcatttcttcaaactgctttttagtgatgcgtttaaagtatttgcgctcgcttgcatcaatcatgattgacgcaccctcataatcatgagtttctaccaaatacactttacccataacattaaccgtaagaactttaaagcccctgtgaagcacaccatacaggaacttgttatgttgtggatagcgtttaacaaattcctctgcggactcagcattacggaaagtgtaataacgacctcgttcaaaaacagcatcatttgaagacttagctggatacaatttatacgttttctgtaccataatataatcctctatcatttcactaattgaacagcacgaaacagaatgcggtcacacggaagaagcataaattcccaacgcggatcaaagtctttagcggtatatgttttcccatcaaccgagatttcacttacataaccaataggtgacactttaagaacagtaaacccattcttgatgacttcgtaggtatctttcaatccttcgtagtcatcctctaggaagtctttacgtgcttgctcagatttaaaaacataggcaacaccggatttaaacatcttacgcattgttgattctccttcttgattagatgggagtattttactactcccatttcttattgtcaactactatcttaatctttgtataaattgtttcttatacttcttcgtgatctcttctcttgtatccgcgtcacagtaatcgaaaccttctgcgtccataatagcaaccatctccgcgcgtgtcaagcgtgaaaatcgttttactttatcaacagcatattgaggatgtaaatgattgttggtgtagtctcctttgatgtaattaacatagtttgtagcccaaacaacgaaatcagcacctaaagcaccaacaccaaaccgtttaaagtctccggtcaacgatccttctaggcggttgcaacacgaatgaagcaatccccttacgcggccttgccctttcccatctagatcgtggtcgtggtcaagatggtttttgctcatatcctcaaaaagtggcatttgacaaagggggcaaatgcccccctgtttttcgaatagttcttgtttgtactctttagcactcttagcagtcagtaacataaattcaccctccaaagaaggtatttaaccattaatcttgtttttgactacaaaggatcggaactcatcaaagccaccgatataatcaccatcatagaaaatctgcggcatggtggcaataacttctacccctgcgcgatcctgaatatcggcaatgatagaatcaatctttaccggacgaccgttttcgtccacaccatcattaaccggaatgtagatgtaagggatcttacgcgcttcacaaaggcgctttgcattctggcaatacttacagttgtaaccttcaaaaccaaaaatttctaccatgttatacctcaatctacgttagttacataaacttcttgcgtatcagaagacttaccacctgaacgatctaggcaataggtcttattcaacaggacgcagtttaaatcattccgcttgataaagtcaaggagatggtcatttacctttcccttatgatgtgtcacattactgataccaaactgaaaaccacgcgccataatagattctacccactgatagaatttaatctcttcctcgtcactccagaatttattatattccgcagaagtgataaggtacggcgggtccaaataaacgaaatcacctggcaagatctcgatctcgtcataacgaccagacgtaaaactgattcgaccgtctttgttttcttccttaaaattcaggacacgctctaccgcgttttcgttaaaagttcggcgaccaaaattagcattaaattctcccttccggttatggcggttaaggttgctaaaactgtgctgaatcaacacaaacagcgatagagggtctggattctcgttatacttcttacggaatgtcatgtaagcgtctttatcttcgcgagacaaaccattttcggcaataatacgcttgatcgtagaaaccggatcaggacactcgtcaatcgctttgtacgcgtctattaatcggtgatcatagtcattagccagaacatccccttcgacgtacagagacacgctcaagccgccacaaaaggcatcaacaaagcggttatagtgcttagggaaatacttactaacaccaggcaataacttttccttattgccagtatagggaattaaacctaatgctttcttcattatcccttcctcaaataagttcgctcaatctctaccagttcaaaaaattcttgccaatcacacggaaaattgcagtttccgaaatgatcctctttgtaaagttctttaccggatggcagcttaatatctgttacgctgtagtatccgcaacaatcgcaatcaccctctgtatattctgttttggtaggaatatccatcattgccagatacaaaggtacatcgtcttgctcaaagttcatgtaaccttcatggtcgaatgaaacaaagttatcatcgccaccgaaagggatataatggtcataatcggttacaggttgaccgtgcaattcccattctacaattttaacattaccgctaaacttgatacccataatttcaacaagaaaatgagtatcgtcaatgtaaatcttactaggagttggataacccattatataatcctcatatctcagagaatagaatctctgttagcttcactgactgctctctgaatgttagcgtatactcgaaaggaaagtcaacacccaacttcaaaagagaatagcctacagcctctttatgcttatcagttagggcgatcctaaccaattcccgttgaatctctttaggcggtgaatggatagtaacacgggtatcatgcaatgtccagtcaccattacgaatcaagattaacggtttatcgtcattgaagatcaccgacccctttccggtcggtgagtgttttatactaatcatcaaattctaagaaatattctggaacgatatacccgttaaagtcattgcacttataaaaatgtggtgcattcaatgctggatgagcattagtaaagagtttaccctctagaaacagaatgtaattaataggtctaataccgacagaatcagggtctaaacctttttctttcagttcagccagcgttaaaactcgtccagatcgtaacttagccatgatttacccccaattcatcaagattatgtcgcagcatttcagagtatttttctacttccttgatcttagtgtggatctccacgatctcatcttcactatcagatagtttaatggcaatcgcgagcgtgcttttaccagctttcatagtctctttccgttcaaccaatagatccgcgtgtttcaatagcaattcttcacgtcgaacataagcgacggtcaaagcctcatcagcgatttctaaagcattttcagcgacaccaacaaccattttacgagtagacagcataaattcacctcacattatttcacgttaacgccgtcatcaatccagccgacgctatttggtttaacagttttaccataggatgcatacttaatcaagcatggtttaacatcattatcaaatcttcctaaacgtactcccaaatcaggaatatccatgtatgcggctttatatccccatgtgccatattcagaatcaatctcaaccggacggcctttaaaagcatacactacaccgtgacggtcaatgataacatagcaataaccagccggaagatacacagtttcgccgtaaactttaactggagtagccgaagagataaacataatataatcctcacatcgttcatttgatacggtcattatatgataaccgcattttcatgtcaaacagtttttaaaaatcttcttccggtttatatcgtccgtcatcaactggttttgggctgaatccggtatgtttgcgcggcttcgcttccggtttccccgcgatcgatagtccaagccatttaagaagtttgtatgagtaagcgatgatcacaactacccacgttaaaggccatacaatagaacaaatggcatatgctccggtatcgacctctttggtgtccttatcgaatctggcatacaagcaaattataagataggtgatcattgcaccagtaggccaaatataaagcacattaacaatatcttgtgttgtcacgttatcctccttacatgtcttgcagtgcataaaagcatttttcttcgtagtcatagaaaatgtcaaagtatgctttttctacatactcaccattgatccaatcggcagtaacaatcagagtagtccagttagatccgctctcaactgtaaaggttttaatacccagcttaacagccaagtcgcgagcaaactggtcgcaaccacggcaggaagtgatattggaagttttgattttaaagccaccgcgagttttagaaatttctactttagcgaaagacaggttgctcattttgattctccttaagaaagtgtgtttcgttttgatgtgtgtagtataggggatcaccgatcccctgtcaacaacttttttatgattttagtgaattaaccactacatcaaaatgatggacagagcacaccttattaaacacatactcatcgtgtttaggaatagcgcctaaccgctttatttcgctcgctgacacgataaaccgtttatccggtgcatttaccttacatgcttcaacaacgcacgggaaacgcgtttcagagagttctggatagttttctgaatccatcaggacaatgaataccctgttacattgattgtagaatcctgtttttgatttcatcaagttttcttctctgtacaattcgtgcaatcttcctttcatgatttcgttggttcttgtcttcacagtttacccattcaacaagatctttacccaactcgaaagcccattctcggtcttgctttacgttttgtaggtatggactttctgacactctacgaagtgatgttgtcgtaacaagaatgatcccaggaatggtcggatgttcttttccatatacaataggacgcgagtcactatcaataccttgtaagaaggtgtatcctgaatcacttagaatcatatactttttcatttcacacatcacagtttcctcaaccagttattaaagcgagtaaaccatgatgcttttcgtgcttcttttactttatgtgcacgcaaaccactgaaacaccattcataatcatcactgaaacatgattccacaggaacacccgcatttcgtagttctctggtctttatcatgaatccttgacataaggggcgaccttcaacaatgataggaagtttaactttttccatgaaagtatacccagcacggtcaataatttcaatcttcataatataatcctcaattagttataccacccaggcttcatttgcacgaaaacaccattcatactcaggaaaataacctttaattggtacgccagctttttgtagttcctgcgtttctacaagataatcaagcccataacgacgaccttccacgatgataggaagtttaacgccattcatgaaagaaaatccaccgtcatcaataatttcaattttcatttacattatctccatagatctttccagcaatatcaatttcaccagcgcgaacatctaggataagatgcggtaggtgtatgtagttttcccaccctacgcgcttcatttctgaaacagtgacgtaagcccatccgttcgctgtaataaagtctacttcaaccttgagaggaaagcaagacttttctatgttttcaaatccgataatgtgttttgtcgttgaatatggaatatatccgatgatcattttgtgatctccttatactcaacacaccataagcgggtagcccatgataaacgctcataacgctggcagaaatcggaccatagatattgtgtaccgtcttgcatggttgaaatatgcgttttctcacctactttcacgaaagaagtattcgattttgtgatctcgaccggagtatatccgaaagcgggttccaagtcaacatctgaactaaatgccaatttaacagaatttgtttttctgaccgctgtccggtttccttctgggtatagcacagcaggtttagcgcctaagcggataaactcagtatttttaatgaacagaatatcatgataaccgtcatattccgacacttccatagtaacaggaaaatcgacatgttttaaacctggtagatctcgcatatcatgaaatgtagccatcaactttttcatattgtattcctcactcttctgtttcatttcttttatatggtacgataacaggattaatacagcaagcaccaattacgttatgagcaccacaatttaagcatttatagtcatggaacttattaaggaatcgaccaaactcataaccgactagcgccgcatgtacttgagtctcgatctcatccatatcagccaatgttttaaccttcatagtataatcctcaaatggtagttttgcgaagatggtcattacacgcttttaatgcatcagtcgcggtgtcatagcgagtattatcatagcaccaataaccatctgtcaactgataaattaatccatcctttttagcttcgatgaaagacagttctttgaatgtttctactttctttgctgatactccacggtcacggcgtttatagagtttagctaaaatgcgttcagcttgttcctctttatcacccgacagatcccagatgatgtttcggatatgcttgattaattgttcagtggtcatctttgattctccttagttggtatgcgtgcattatagcattgtgattatctttgtcaacacccaaaaacaaaaaaggctaccccgaaggatagcccataaaattacacgcgagcaccgtagatcgtgcctactttatcccagcgaggggcattgccagtaacagccttaccagccgctccgccattatattccgatccctgtccacggatattacatttaccaccagcgccaccagcatcaccaccgttaccgccattatatacaccgttgacagaccctttacctggcgcggaaatagtaccagcagtagcaccctgttccatattagcagacccaccggcagcgccaaatggacgaccgccgccacctccaaaagtcaatttcatttgtggaaaaggagaccagtatcctccgccgccaccgccaccgccaccgcaaatagcgccgttatttgtgatgcgtaagcgtgtgcctataccgttgttaattgcattaccaccagcaccaccagcggagttattgccaccattaccaccacgcccccaaacatgaacaccggagttgatgatcagtgttacatactcgtttgttaacgagctagggaagtcaagacaaggaacgccagtagattgggaaacaatattacctgtgatagtaattactacaggagtagatccttgtgctttcatccagttaataagagtgtctttattgtaagagttactagcaccaatgctataatgaatctctttagagcgtccgaccattgccgacatatacgccggacgacctaagcgtacagcttgcattgcggcgctcatccaccgttgaccagtctcggacacagcagatgatcctacccatccagaagatattgccataaaatttcctcacaagaaaagccccatttaaggggcattgattgataatattacttagatgacctctgcttcaccattcaggaagaaagaccatgttttgttaggatagcgaagcgcccatgattcagcagttttaacaccagcttcgaacaattgacgactggtcactttagccataccatcttcgatggcaacgttttcaataatcatcgggtacttagcgccacgcatgaaaccgaagccagcggaagatttgataattttaacagttgccatttttgattctcctagaaagtgtcgtgtttcgatgggtgtattatgcaataacacaggatcgctgtcaacactttctaagaaaaaatttaaactaatcgaatataaccaagaatttcagcgcctttagccagtcctaaaacttcccattcaaggtcgccgtagtcataatttgcaaccatcaactgaccatttttcatgcagcaatcatgagagaaaatttgccccgcataaactacgatagtaataaactttcctgattctggcggtgtggaagacaaagcgaccatatgaccattcagcttagtcaccagtgatggaacaataaaattcgggcttacctgaataccgttaaattcgtttgtgtctttcatgccagacctcgcaaaacactaatagcataatcatgctggttattcataatatcgattgcattgtgataacgagctaaaccatcaaggataaattcttgtttatcctgtttcagtttggtatcacgcgcagccataagagcatcaagaacaggtccaaagtgattatctaattcatcttcggttgcaatgtttcctattgcctcgtcgatccgtgattctaatgcttgtttttcgttgatcacttgctgggtatattccaacacatcaagaatatcgcgggtaacgtcgccatgataaggtattcccgcatgaagatgatcaattagtcgttgaatgtcaatgttcatttgtaaccctcctctgaaagcacatcccagatcgttgagtcaaggtgcattaaattccacataatagagtcataactaccgaagccagaagtaaaaattacatcacactggcgataggtcttatgaaaatcggtggctgtctctgcatcaataggcatatcgtcaccggaaagcaccagacatttaagaatcataactctgttagccgttggcgcttgcttagtcttttcagcatatttttcgatgatccgttttgccttttcttctttgatacgtccagaccaaatccggtttcggtattgattcataataatttcaatcacatcattttgcattcttcacggtctccataattgttttgtaagccagtttaagatgatcaccgaaaaactttgcggtgttacccttcggatcgcggagcatggtttctacgatctaatcggcagtaacaatttctcctttctttgctgcatgttctaccatatacttcaaagtttcttcggaagcaagtgctgcggctactggattaatcatttttgattctcctttgttttcgatgtgtgcattatgctataccctattccggttgtcaacacctaaaaacgaaaaagccaccctttcggatggcttttgattatattttattcacgtccatttgtatagtagtgtttgaatcgacctttgctaaactagttaaacatagtaaccaattcaccatccctttccaatgataaccctccctcgtcttagacgggtcttccgattcggcagtaattgaacacgcgaaagtatgaggaagccaaatagttgtgttaatgctagtattcttttacttctggtatgcatcccacggtgactaacattaagccagtcgagtgagtttataaattgttttaaagcatagagatttgatatcgtctaaaacgctctgtaacgagctatcaacatcattataaatctcactagccatttgcgttaactcttgcaaataggcaatttcgctaatctccttgcggacgaccaacgttggctgataacgaccagtgatcccaatattggtttcagtgaaatcatcaaccaattcttgcatttcaagatagaactcttctagagccttatgttttgcataagatccaggaccagttaccccaaaatgcgcagaatgcatataagtaacactcatcagacattcaccgataaagcggtcaactttattagcctttccctcttcggacgtctttcgaaaatcactgaatttcatgttctcgattctccatattatgcaacacaacaaattggtttgcggcatattcccccataataaaacactgcttagaatccatacatttactacgagcatacatcttcataatatgggcatgaaatttctggctggtttcaatggaaggagatattttgtttacatatactatcattgcaccgtcgaaataatcagtaaagtcaccagttggatcatattgatcagcactgacacttccgaccgcagtcaagcatattgccgctgttagagttttacgaataaatgacataagtcattcccccagattgaaaatattcagttatatttataatccggggctttatttatgattaactcttatttggtagtaccatcaataaaatgtttacgacacacagaaacatatttatcctctgcaccaacttctatttgagcaccatcgcgaataacattaccatctttatctacgcgaaggaccatagtcgctttcttgccacaatgacaaatacccttcatttcgaccagtttatcagcaaatgccattaatgccgcagatccttcaaatagattgccctgaaagtcagtgcgaaggccatagcacagtacagggatatttgcatcatcaacaagcgcacacaagcctaaaacatgctctttagtcataaattgggcttcatctacaaatactgcatctggacgccatcgatccggtctacgcttacctaacgattcacgataaaccaagtcgaaaagatcatccgatttagtgaaggtgatcgctggagcacttaggccaattcgggaaacgacttcactttctgaatctcgattatcaatcgctggcttaagaattaatactcgcatatcacgttctgtatagttataagcactttgtaacagagaagttgatttgccagcgttcatagatgcatagtagaaatataattgcgccattaattaatctccaaaaatccaacaagacctaaaccgatataagtccagatacaaaggaaaaagaagcaaacacccatagcaaagataaatccgcgtagtgtctttggataacctacccaatattcccgaccatcttctaaccggatcagcttatttccttgagagtccatatcaattacaacatgtttatttctggattgtaacagatattgcttgacaatctcaatacccgccataataacaataacgaaattgaaagtccacataacaaggttaatggtagtctcaagcattttctatcacctccacccaatcaggcgtttcctgaaatactccttcgccttcgtggtggatgcatcctttattgctacaatacatccaccaatcccacattccccacggtaaacgctgcatatcgtcgttacagcaagtgaagacaataggccaaccacatctaacacatcggcagttttccttcatgtgagcggtattaggcttcttcatagatgactccaatataatcgacatttacatttagggcaatgcggttctttaatataatacccgtctgtctttggaacactaacaggagcggtttttatattgtattccgtgaaacaacgaaaacaagttacgttttctacagactgacgtttcacccaatcaccggaatatagatcatttttatttgtcatattcaaccaccacaatgttaatgtctggagtagcaatattaatgatctcttctacacattcccactcaaggccaccgataccgcaaccgattttaggaatatagaaaggctgtatagcaccctcaaaaacatcattgagagcctcaaatcctttcaggatagcaccatattcagcatttggacccggtcggaattgggtatagagattcaccccgcaccagttataaccattaacttgatgcgtccagacactaaacccacccagcttttcgaccttaccgcgagaagtttgcttgtcaatctctaacgcttgcgggaactctttcgcgatctttgcagcaataccagcgcccatagtatgaaaacaattacaaccatgaattaaatgaccgtttccttgtttaaacagggcgatgagatcgccctttacagtatcaataatcataatataaacctctcattagtcacgggaagacaacccagccataaaacggcttaacagtgtgtcgcgataagcaaagcataattgcttatcgggggcagtatcacacaggttgcgttttgttttagcaaagctggcaatactcagatcccacgctcgattttttcgtttttcgtctcgaccttgtttgtatgcctcgtcaagttcaagtgcgataaaatcgctacacatgttatcatcatcacagaaggttttaatgatctttttgttgatctcaaatcctttgtattcgaactttggataagggcgctcattactagcaagcgcaccagccgagaacatcatagcaatcatagcaactattgtcaactttttcatatattcctcaatagcgtttagttttaagaatgcctttactctttagatggttagccttttttagtacgtcatcagcatagcctaacccagctttatagttccatccagcattgtaagaagctagcgcgagtcggatattaccgtttctaacatccagccagtatgctaactcatccatcgcgtagaatgcagaaacctcgcgattcatgataaagttgatagtctggcgatcactcattttaacaccgcgctttgcatttttcgctttcaccgttttaaggtaattttgaaataatccataagcatgatgatttttctttggtgctaagtttgcacccgcgcttgattcttgccatgcgatacccgccaggatgtgacctaaaccctttccgttatagcgaatattcggatggtcctttttcaacttaccgcttttctcgaattgttcgccgtattgataggcgaaatgtaaattatctagttggtgtgctgtaaagttgtctatcggcgcttttttgatcggtgcgctagtcgatgcgtgtgtagcaccaacggctagtgacagactcaatactatcgcttttagaacttttaacattaatttctcctgtttggcttaactttctgattccataatatagccatatcaccagaaagtcaagcattattttaaccaatctccattattggtcaactttcaaaacaacagccgacattttacccgccagtcgttttggattctctataatcattcggcagcatagaccgtgatatggcttaccgtcttcaattaggtctactgtcatcccgatccacatgttaccgtcagtaatttctaatcgattaggtcggtcttccattttcaggaagtcgaagatctccggcaaacgagtttctaccttattgaatagttccattgtcttatgttcatcgatatgacgatcggttagacggtcgatcatatgcggactaaagcgaatgaaaatatactcaccgtaaccattattcaagcacttttctttgatttgtgcgttagtcttacgcatttcagtttcgaagaatctgcgcagcttgctacggcgaacgtgtacattaattgtttccattttattctcctttcttaaacaaattgcgaagccagtatacaaacgggatttctttaaacttgaatttctctatagttaattctttagtagcaagatgaataccataagcatcatgtgtcacgatatgccattttctatagtccaaatgtgaacaaccgtctggatctaggttaataagagtttctcgctcactaggattattcttccacaattttgtaaccggatcgcacataattcgacctagcgtaccatgaataatctcacaacggtaaagttttccagcagtgagatagtcgcacccgtcatagtcagtataaacaaatacttctttaacactcattttaatactcctttgttgtttcgatgggggtatattactacccccggtcatgtgtgtcaactactttttcaagaattttttaattgcgttccaaagacctttattctcaggttgttttggttcttcgacaagtgtccacggacggtcgtcaaggtatgcacagcttttcagagaaataaaaagtttgtatcctttatcatctctgatgtaaccgtaggtagacattctttcatccggcgtaaacttatacagtttatttggggtgatgtaagatctactactataaggtgtcatcacatacatcatggcactaactcccatttatcaccgcgaagatgagaacatccaccatcaagaagtatcgtaatacgataacctatatcatcttttatgtaaccgattgtcggtggattttcgtcgtctcgtgccggggtaaaatcatacatctttacgggcgtaatatcttgtcctttattgctattggtataaactcgcattttcttaatctcctatattaactaaccacgggtatagtgttccagaacaacggtcagatgaatatattctaataaatctttccaaaagtcaacatctggttcttccggcataccgtttttctttgcctcttcacgcgcgagtttaacacgttcgtagagatctttcaattcttcccgcacattatcaaaggttctttctcctaacttacatgctaaaatagaaccacgtttagcgagcgggaattgtaaatcacctgtctgatagatttcaagtagctgataaccaacacgcagagcatgagaaagatctttccagttactgaaatacttttcagatttggctacctgctttttgagatagccagacaaaccccacataccaacatgatagaatttatctcgatgtgttcggatgtattcccattctctggaggattcaatcaacatgttactaggcgcgtgcaccatatcaatagcgccgatatcacctttacatgccagagtgataaaccgttttagactgaacatattaacatcaatatcgtctttggtgttcttgataccttgaccgctagtgctttggtcatagtgttctttcatcgatcctaagataatttctttcgcagtcggaacaaagataccacgataatctttatctgaattttcagtatcaaggccgtataagtgagatccgaagaccattttaaccattgtatgcataattaaaccctcaattgattaagagattacatcataacatcataaaaagaaaaagccatccctttttggattggcttgatgaaaaattagagagattcggtaaaggtacgcgcgataacgtcacgctgctggtctggagtcagactattgaagcgcactgcgtaaccagaaacgcgaattgtaagctgcgggtacttctcaggatgttcaaccgcgtcaagtaacatttctcgtaacaatacgttaacatttaggtgctgaccaccttcgacaacaggagcaccattatctacaatgacaggacggaagctagttgtgtgcagtgccagcgaatcgacgtcttctgcggtgatcacatggtcttctgcgaaagttttactaacaattactttagcgccgatcagtgctttcggttcggataccagaatcataggcgcgaagtgtccaccaataatagtacctttatgctcacctttcatgatttgaattgctttaaattccataattcacctcttatagatcaggacgttcgtcattaattttaccaaccaaaacaccatagagtttatcaggttggattttacgattctttttaattgtagcacgaaatcgacgagctacgctatctttatttttcattagttgatacctaagccaatgaaaataggttggtcttctacactaccccttccaacactaagtcgattcaattctaaaaactgcaatacgctgtcagtaaatccgcgcatggtagtatctaggataaagattgttctgtcaagactacgacctcgccatgtgatcggattcaggaaagttcggatcgacgtgcaatctacatttgaaatattgacattttcaccacgaccgcgatctcggatcgttttggcatgttcccgcgtcgttgaaacgataaagacgctatagccttttctagtataatggtcatataacttgattgtagcgtctgtatgccctgtctgacggcctaaattgattgagacgatggaatctaggtcatcagcaaaattgcgtcgcttacggcgttctatgatgccatctacggcagaaacacacgcagcataaatcaaatctttactttctaattttacatcaatattcattgtcaagtctccagtgaacggggagagatccttagattgtctccccgttgatggttaatattttattttggatctgggtatttgctgtgtggcaattgtagatgaggaccatctttaaaactagtccaatccccgccccattcaacaggaacacccaattctcgaccagcttgtttaaacgcatcagcgatcatgcggtaatatttcatgttccatgtatctttatctttcggatacgctacaacatcaaccgcgaaaccgtgaagatgacgagatttcatagtcttagatttaccttccgcaacatatttcttttgcgtttctagactacgcacaccttccgtaataccaaaatcgaccggagtcagttctaatgcacgatgaacgacttttaccagatcaggatgcacaccaacaagccgttctttgcttctttgagataatttaaacattattcaccccctttgtgagtgataatatttagattccggcgatcctgcatatagttcttgtattagcaccaatcaggatcgcattaacgacaaccattccccaatcaacccactgattattataaatgctaaacccgtttgcaagaccaaatacaagcattccggtacacatactcagagcaataatcaacatcacggtaaaaccaaatgcaaatctcatattattttccttttctctgtttacgtttataaaagtaatacattacctcatcgcgtccggtgatccaacatgctagggcggtaaacaggtttacaattcccaacacacctacggatgcggcgctgtcaacagacataggaacagtaaaggccatagctaacatagcaacgccacaaatgacattaagcaccattataataagaccgaagaaaaccattgtcaatcctcccaaataagaaaaccaacaatcacgccagtgataagacatgatgcgccgctaataagacaacccgcgccaagtgattcccaccagatcagagaagcgacaataacacagaatccccatactaccgcaatcacaacataggcaagggtcgcccaaaacatatatttgttcataataaatcccattcaccaaacaaataagaaaaaagccatatcaacagaaacgaggcaattgatccggcaagcaaaatgatattagagaatccgccgtctatccaggcgacaaaacagaatacgccagtatagaagcataaacccagtacaaagcatactataagcaaccatagacaaaacgccatagaaagccctccagtgagctaatttagtgcgggtagtacattaccctacccgtattgttaatcatcgcagagcttcttctagcgcgatcccaaaccatccacaaacaacgcccatacagacagctacaagaagattcattctctctttagggatcattgcaatcataacaacaaccatacagaaagccattaccattgaagttaacatttgttcaaccattatcacacctttaaagtcatagacgcataaacattaatgccaggccagttaggatcgcaattatactcaacatcccacaaataaagcggtttagatgtatcagccaagtttttaaaatcttctacccacatttcaaggctatatgatggataaactaggctatcatatccgccgtaacgttggcctactggtcggtcagtaaaaactacctcaagatccggtaattctttttcaaggataaccgccagcgcataaatcagacggtcttccttgttacgctgccgaaggaccgttgtcagttggtttttctggttcactagcaagcacctccacattttcacagaatgaaattttcacagacacaattttaccataagtgaagaatgaatatacattatcgagatattcaacgtcacctacaatcacatcaaactgcggatcagcaaccgccgcaacatattctaccagttcatcaagagaatgcaacttaatttcatcaattcggctgtatttggttgcatctttaattttaaaaccacgttctttcagtttgtcaatcagaatttcacgcggagtttcaaacagtttgctcataatataatcctcacattaaatctaaaatttgttaacgacgaattgcataattatactaatcacaaacattgcaaaccaagtataaatgcaacagataaaagctacatacaattcaatctggtcagagaatacaccgggtaaaagcattagcaaaataacaacagtaaagacgctagcgatacccgcaacaaaaccaatatcatttttactaatcgtcatcaagtcaccgttttgtaaagaaacacaataaaatccaagacaagaaagacagtgtaaatgatcatcgtcaagacagtaaacaccgtcagattttcatcgttagttaattcatagtcgcccatccatacaatcacaagatatagcattgaaagaatggaagcacctacgaagttaaaaaacatattcttgagcgtcatattaacaaccatcgcggcttaagtcaacagcaattgcatacagcataatgaatatgctagccgatccgagaatcaatgcaccgtcacattttgaaactcgctcatcaaaatacaacattatccatccgaggatgttaaaggcgcacaccgcgcctatgttcgctaaccaattaatctttttcataatataccttagaaagaaacagttttcaagaaatccagattttcagtaccgaaaacagaaaagtagtgttttcctttttcggttttagagaaagcgattgtcttctctacatggtgacggaagccagacagacgatcacccaggtcaaggcggcaagcgtaagtagtgccgttttcgaaagtaacctcgatttgagttttgtcatattcgctttcataggcttttgctgccgcgtcctgtgctttacgctcgaagtcttcgaagtggaatacttcgtttgcgttagcgaatacagaagattcagagaagataactttaacagatactggtttcattttgatactccttagtagttcgtgtttcgtttcgatgggtgtattatgctatacaccctctcgcgtgtcaacaacttttttagtcttttttcataatttctagagcagtttctacagcacctttccaaccttcccacataatggacatagtaaggaagttaaagcacccgcaggaatcaacctttttagagataaaccattctacaaacgcttcgctcataccatgctctttagcggattcgcataattgttcaatttggtcttccatagtatcacctcaacacttaacgttattcaaactcaaacggtctattcaacctattgtaaaagtacatataacaagcaaaattatgctttggctgtaccgtatcagatagacactcttttacagcctcgcggtccgatgggtctacaccctcagctttaagtaatgctaaaatctggttatagcgtactcttagttgtactaatggtttatcccccatattacccccttatagttgatcagcaatgtatgcggtgcatttgcggagtttagccatagcaccacctttcatgtcgcttgcgcctacaatgttcatgatctctaagcgatcagccggattcagtctagtagcccagatctggttagccagttccattttacccatctgcggttccatctcaaacatttcacgctcaaagtcgataatttcttttgctgcgtctttaaagttaatcattttggtcctcccgtttcgttgatggttgtattgtaggggagttatcctcccctgtcaacacttttatcagaaatatgcaatatagtttgccagtcctacagagtcatcattcggcattgcttttaccgccagttcaaaccctgcttcaactttctgtttagcggattcttcgttataaccccagatgaccagaatagctactacgttttctttgcttactgctttcagtgctttagtgatgcgacgtgccataatttgattctccgtttaagaaagtgtgtttcgatgggtgtattatgctataggcgtgatctggtgtcaacaacttttttaaaaattttaggcaataaaaaagccactccgaagagtggcttatagggaaggtagcgaatcttccttgtctccaacctgctagcggcctagcaagtgaatgctttagcgtaccggatcaccccatacgctgtaataaatgcggctaggtgacgtccaaatcattctaaccgcgctgtctttagttcactattatttatatcgctttctctcgcgacgtttttgatcttcttccttgatagagttaaacgcatcaaaaagacacatgacactgataatgaacataaccgtattttctacgatatcccacggcttcgcatcagtacagatcccccaaacggtaagaaatgcaaatagtgcagaagagatcacaagcatgatacttgctaagatataaaaagtcattttcatggttttacctcaattcttcgatattcatcacacatccacgcagtaagcaagaatcccagcacataagcaacaaaatacgttaatgcttcttctggtttcgtgctatgtatcatcagtaaaccagcgagaacggtcttaacaattacatttaaaataactagccacgcaaataatttcatcgtttgccccatttcggtcgagtcttttcaaacttatacattccgtaacaatctcgaatcatccacgtaacaagagcaccagtcaacacagacaatacacagaagaagtaaaacggtccggttgcattatcaacatgagcaagccaggtaaagaaaacacatgctaagaatgtaaagaacatcataaagcacaagaaagcgaaatattttatactactcatagcgccaccatacaacagatcataagaaaacccaacgcaataagaattgcatcaaatttagtgaactcaggtccacctatcaacatcattcgttctatttcgttcatagcgtacaaagccatttaaaagcaccacataaagcgagcagaatactaggtataaacgagaccataacaagtttgcaaaaatcatctaaggtaacaccggaatagctacctactgtaacaacaccgatcatcagacacagaaagaaaacaaatgcaatcataaacaaagtattgctaaacagtttagtgatcattagacaccccacgacgatcaatttcaaaaacttttttatcatcaacgaagcatgtcacaactgcctcgttgacttccgcaaattgttgtgttacccacttaaggtcagagcgaaacaatgttctattaataacaaatgttttaccgctcttatccttacccataaattttgctttaaccatatccaattccatattatcaccttatttgctaatcgctaaacccaatccgaagagagcacccgatgctacagtatacccgaaagtttcaaatgcagtaaagatatctaagccaccagctaacagagttgcagtaaacagagtaccagctacgaacataaaagttttaccgatgaatttcattttgattctcctttcgtttgtttgtgggggtatcttactacccccgtttcatgttgtcaactatttttaagaatattttacttcgtctacaatgtctttcatgacattgatttccattccggtcagaacacgttggaacatgtgctgcacatacgctttcaggtattcatttgatggcttactatcgaaagtctttttagtgtagtagtcatcaccgaaagctactgtaattacattttcgtcgtcgctccaagcgatataagcaaatttgccgttatcccagaagcgagcactaattgctacttttgttgaatcgaatcctacttcgctgtgagattcaagaactacttgtgtgccagtttctttatgaatgtagtagcgggatactaagtcaaagttacgggtgtagtgacattcgaatttatctttaaacatcatcatttttgattctcctaagtgtgtttcgtttcgatgtgtgcattatgctatagtcgtttatggttgtcaacacataaaaacaaaaaaccccgaaaaattttcggggtataaaattacagtttggtcgtccactccaggtctagatcttcgacatactcatgagatcggacaatctctaaatcgaactctaggtcagtgccaaatttacgcgcaccaacatcataagaaagcgtgatatgcggtacatattcaggataatcccacgtcgcgcctaaagcagtgcctatatcgtgtctgaattgcatgtagtcgctttcaaatgccaacacaagcgcattagtaccggattgagtttcaaacactttaagatggcatagagagcctaaaaacttttcaccctcttctggtataaacggaacatagacacgagaatataagatagtgctatgcagtttatcacgaggaacggcattaggcagatcgtagaactcctgcaatttttcaatgcggtctagtgtatcctcagtgaatttaacagccgcatatgtacctttaacggattctctaaacggggtcataatcaagcctccgtgatcagttctacttcctcttctgcttcttctgcggcttcgtctttagggagaagtgctttcacttcttcgacaatagcatcaagggaaacagtgccgttttcgtctggctgaatacccagaatgcgtaccagttccatcaatacacgctcacgatctttcagttggccttctaagaatgcggccttttcttgagtgtcaaacagacgtactttcaggacattaatcatttgttcatgctgattggacatattcacatctcctacttgttgataactttttattaaatgttcgcgagaatcgcgctttcaaattcttctaatgtaccattatttatgatgatggtttcaccgtcaataggcaaaattcctttttcggtggagtgagtcgatacaataccagtatcacgctgaatatgcaacaccttagcacccatagcacgcatgagagcaatttcaataggctgacgcacatcaaccactacaaaatacccttcttcatttttgcgcttcataaactcattcacgaagagattacaccaataaagcggattgatcaagttaaccattatatcagtaccgagagtggttaacatgagacgaatagaccagacgttattatgtttttcgccaatctcattaacgaccttgtaaatctcagccagacgatcacaagtaaaggaactaccgccatacttcgaatctagcataagcagacactgaataaaccacttatgcgcagtataggtatcaatacctagatcggcttctctgtcacgccctaacccgtcaaagtcaagataagtcagacctaagtctggttgacattcgcacaatatttctttgatcggtgctgccagttgataactatgtccatcaatgattaacgcggcagtgtcttttcctactcgctttttaccacaaagtgcaatcaatttcattatataagcctcttattactttctaaaagcagggtgcatagctttaataccttccaccctctgacgatccgccgcctgaattgctgggcgaggaacgatcagttgaccatcacgttcaatgctcattgttttaaagggaagaattgcagtacacaccagagattcatgcatatcatcggtgtatgttaactcaagttcccccaattgtgaacaccaacaaccataaaagttaaaagtgcacacaatgttacgtcgttcgttgtccatcatgtgaacttgaacggcttccggcattgaatccttccacgcagtggagttaccgttattgtagtctactatagaaagcatccatgtgtaaaggtttagatagctttccaaatgctcatcgacaataaaccggactaccaacgggtcaaactccacatgactagacggataatcagcgaccgccaaaccatattgaccagcaacttgcttagtcggtggaatggttatagcaggaagtgtaacaccttgagcatttaaagtaaagccttttgttagttgtccatctggaatattgatctgccagttgctagggttagcatagttaaagagattagacattactgattcctcaaatgaaaatatttattaacaattgtcgctttgcgacgtgccgtaggcactgactactttttaaccgaaacaaatttttattattctaaagatctttcttcgttttggttatgttttaaccaataactatatttttatacagtaataaataaaacgggtactatacgaggacttcttatgacagaagacattttgttaaaactctatgatcgtctggataacgaattagcaacattgcggggtgaagttctctatttgtctaaatgcaatacagatctgcttaagcagattgcagaaagggatgatcaaataaaatccctttcaggtgcattacgtgatcgcgacaaggcattagagattttacagcgtgttaccaataaggaagaattaaaagacttcttacatggctatgctcatgctatcgatctataataaaaaagcccgtcattgacgggcttaattttaatatgtatcagctaatttaattatgttatcaagttccgtgatgggtaaagtttctgtgtatccatctttcaacatggatttatcaacaacgccacaatgataagttctctttatttccttttcaagttcccacggaatccagccatcaacactttgtttgacgtaaacaagtttgtgaacaaacttagatttttgcatatgttgtttcattctggtttccggtaattcattggttacaccaaactttataaatttatcatctaacgtctggatataaaaatatcccatctcagatggacgatagccagaagaactacatttcggacaccctttagcatttctgttgaaagtacaatatcttacagaaaattccgcgtcatgttttgtacatttaagttttatccatgaatttgcagtacctatccattcaccatcgacacctatatattcataccctaactttttacatttatcttctattctagatagtgcatcttccacgggaacgacatattccgtcttaaattgttcagccgcacatttcttacaaccacatgtaccatgatttttaaaatcaaagaactttgtattcttccaaatatggtcatgtttcttgcatctaagaatcatcttagtaatttgtgatttccagccaccaacaaatcccaaaaattcataatcaagatctttacatttttcttcaatgaatttggttgcttcctcttctgtcataactcccctacattgagggcaaccaacaataacctttttagcatagaaactattactggaaacatcatagacagatccatgcttattgcattggataacagatctagtcaattttcctttccattctccagaaaatcctaagaatgtatggtcgacaagtttacacctttcaataactttatccgcaaattctctaggagattttgttactttgtttactctgtattctatttcttccggttgacgaagaacataaacgtggggattgctccccacggaattaatattaagcatccttccacaccttccttgcatcatagtttttacctttagaaacaaatttatatgtgttaaggtagataatattgctccagtctttcgggctaatctcaacaagttttgttttaatgtgtcccggtagatatgctttgatcatgtggtcactaccacgcataccttttacatcgctccatttgatttttaagcgtgttttattactcaaggtaggagtagatgcatattgctttaaaagtgcttccagaaactgctgacgggctttaggcgttacatagtgtaagttaagacccagcattacagtattacctgcctttgtcttagaatcacccagacaaatgatcagcgggaaaacatcccaatatggcaaagtgtctttatacttagcatcatacataaaggtatagattcgccctacttgcggttttacaatctggtgtccctttattcccgcttttattgttttagtaaaccactcctgtgatttttctttaggacgactctttgatacaacacgcatagacgcacgaaaatcattaatcatcatcattgcgcgttgctgcttattgagaccctttgcacttttcccttttagtttttcaacttctattgctgttttaatttcgctggcataacgagacatacttttagtgaaagtcgcataggctattcccttagaatctgcaaatgctttagctgtcatgcctttggcttttgctttcgcaaattctacacccaattcgacccactgtttagactttcgtttttggggagacggcttttcgtcttctgtgattatttcaaatacgctcataatattatcctctatttgttaagccctttaaagccaaacactttctttaatgcatgttcggtgatgatcttaaactccatgttatgcttttggcacaaatcaaccgcagctttccacttttccgtgtttacagtatatgtgtaacactcttgcatgtatctttgcttagtcttagtggttattctttttggcctttccggtggccgtgtctcttttgccggtttaacttcccacaagaactctttaccatctacaaatttcacccaaaaatccatatgatactttctggatcgtttatctgcgctagaccagtaaggtataatcacacactcagagttccatttagacacgctaggactacggtccaaaaatttcattatgtgcaattcccagcttgatctataagtgattttatgcaagttgtttcctttgtacttctcaggattttctggcttgaacttgcccttataagtgttagatcctcccattttagcaccctttattataaatacataatactatttatcaattgagggtgataaaatgctcttttctttcttccctgccattgaatacaacggcaagatgattactgacattgtgcgcaattaccgcgcatatttcaacgcaataatttctgattataacatacaaacatattacattcaaggtagtccacgaccggaacaagttgcatatgaagtatacggaaaccaacaactttattggatcttgctgatgcttaatgacgtatacgatccgttccatgactggatcaccgatcaagagacagcatatgaatcagccgaacaacgatatgcaaacgtaggaggaaatcaagtattataccacgttgatattgacggaaacaagtattggaatcttaccgaatatccgaaaggatcaagcaattggtatgataaaggggatattcatcatcgtcatttgcagtttcaaggtgcattatcggcagtagacacactggaagatgcgatcctccgtaatgaggaacgacgcaagatcaagatcatagatcctacacaaattaaacaatttattaacgcattcattcgagaaatggaaaaggctgatgtgtaaggtgattaattatgctaatgtttaataactccgttaaatggtttaccggaattgtagaaaacagggaagacccattaatgctggggcgtgttcaggttaggattcatggtatacatccctcgctatccgcacacggtgacattcaaggtcttccaaccgaagatctattatggattacgccaatacaagatattacaagcgcggcgatctccggtataggtcaaagccctactggtattgttgaaggttcaatggtatttggtttgtctttagatgaacgttatttaaactgcgttattctgggtactattgccggacaatatacagagaaaccactcactacagagggtttttgtgacccttctggtgcatatcctcgttatattggtaatgatgttaatattcttgctcgtggcggtattaacccagaaaccggacaaacaacaaaacctgatagtgtctatattcgagatgaaaacactggagttgcagtaaatccagacgacgagccattagatcaaattccggttgatgataatcctgattttacaatagaaaaaatgttgcgtggcgatgagggatatcgcgagaaatggtatcttgattcagaaggatatccgacaataggcatcgggcatttgatcatttataagaaaaccagtgatctgggtattatcaataatgaactttctaagctggtagggcgtgaagttacaaacggaagacttaccgccgaagaagttagtaaagtatttgcggacgatatagaaaagactcgtcgtgatatgcgcaaacatccacgaattgcacctgtctataataaatgtaatgcctcacgtcgtatggcattagaaaatatggcgtttcaaatgggtgttggtggattgggtaaatttaagaatagtcttgctgcgatgttagcggaagaatggaaacaagcctatgatggattacgtcaatcggtatgggctaaccaaactccaggacgctccagccgtgtttctaaaattattttaactggtaacttagaatcatatggcgtaattgctccaaagaaagaggaatctgtttctgatgatccgcgagcacgtttaagaaatgcccgtattgctgcctataagacgcagagagcagaagaagacccagaagcaccgtttaccccacaagacacacgaatcatgtttaaagagcctaagagttcgtattctgctaggtatccttataaccatgtgtacgagtcagagagcggtcatattatcgagattgatgatactccttctcatgagcgatatcatcgtaaacatccttcgggtacatttgaagaaaccagaccggacggaacgagggtagaaaagattgaaggcgatgattatctgatcgttaaacaaggccggaaagtaaacgttaagggtaatttgcaagttgttgttgaaggtgacgcgcaagtttattatatgggtaatgtgatgcaaaccgttgatggtaacgtcactgaatttattcgtggtaatgttaatcagaccgttgaaggtactgctaacatgcatgttgtaggtgatgttaccgctcagcttgacgctaatttgacggctaacgtcaagggtaatgctgaattaatgatcgagggtaacactaccgaaacaattaaaggtaactatgatttaaccgttgagggtaattttaatatgaccgtcaatggcactaaatcagatcaggttaatggtgactggtcccgtaattgtggtgcaagcgttaaagatattgcatctggtacagttaaaattgatggtagccgtattgatcttgggtgaggtaactaatggttgaaattcttccgatgagttcaaaattggaggatatcagcgagcgagaaatctttgaggtggtgttctcttataaagcaacgccaccagatgcaaataccacatacacgattaaagagtttaagatcagcgagtatcgccctaataagggcgttaccgttgaagaaactaaaatatctggtgagtatctggatagtttttcgcttggcgcggattctcttaaatatataacgaaagatagaattaaaaaatctgccggaagttttgatgatttaccagatccaactaccgcagatctatattattttaacgctcctacacgtctacaggaggtttatacttataaagtaaccctaacctatatccaatctgtttcagagtcttctggtggttctggtgaaggaaatagtggtggttccagtagccgagagggtgctggtgaaactaatccgcctccggtagtaaccgagcacacaatagagaaagtttatactcaaaccgtttttggaaattgggatgtgtggagtaaacagttaagagattatgttagaagaagtgagggataatatgattgaagtaattcattacaccaaagaagatgaaattttatataatagactacatgaactattttatgaagttgacggaaaggtttatagaaggttctctcgtggacgttctaaagccggaagtctagttggtggattgaagataaatccatgtggatatagatattggagacttgctgttgatggtaaagagtttcagaggtctcatgttgtttatcatatgcatcacggacacactccgagaaaaccactacaaatagatcatattaacacaaactcccttgacgaccgagttagcaatttaagaccagcaaccgttactcaacaaatgtacaaccaaaataaacaatccgattgcacatcttcatatattggtgttaattggaataaaaattccaaaaagtgggaagctagaattagagccaatggaaaacgaatccgtttaggtctatttgataatgaaattgacgctgcgattgcctataacaccgctgcattatctagagattcaaaagttaacaaattaaacgatgtatgaagatggggttttgatggctggtttatcatatgacaaagcaaaaactactggacatggcaattacggtccgacaataattaatgcaactcaatctaaggtatttgttgagggtatccctgtattagtcgaaggagacccaattacaccacacacaaaaacaacaaagccttatgatacacacgggggaactacggtcgccagtaccccgaaagtatttgttaccggaaagaaagcaattcaaatggcagatcgtattagctgtggcgataccgtcgctatggcatcaccgaaggtattcataaaatgacaaagcaaaagattacacaaattcctgatatttttaatgctgctacgtttgatgaaattaaaagcgcattaacagactggatgagaaaccaggaagaatttaaagattttgattttaatggtgctggtattaacgtattgatggacttgctcgcatataataccctttatattcagcaattcgccaacgccgctctatatgaatcttttatcagaacggcaattaagcgtagttcagttgttcaagccgcgcaagatttaggatatttgccagcaagtaaaactagtgcatcgactacaattatgttgcacgtatcccatccgcgaaatccggcaagtattcgaatcccacgaggaactaaatttattgcaagtgtggatcgccagacgtcttacccgtttgtgactacagaagacgttgtgagtgttttaggttcaaatggtttatatacgcctatgcttaaagtcgcacaaggtcgtattgttcgtacagaaatgttatttgatccgaagaaacaaattctgatccgtgatcctgatattgaccgcgctcaggttaagttgtgggtagatggtgctgaatggaaagactggacacgagaaagcattgttaacgcaactggtgcaagcaatattttctatatgcgtgaaaccgtagacggtcatacagaaatcttctttggtgaaggtgaatcaactttatctgctgctggcggtgcactggaagcaaattatattggtggacttaagccgtcaactggtgctaatattgttatcgaatatatcagcactaaaggcgcggaagctaacggatctgtcaatttcacatacgcggatacattggcatctatctctattgttaaaattattgagaatccgacaaatgatcgtgattatgtcggtgcagatggtggtggtgatcctgaatcaatcgaacgtattcgtgaacttgctccggtaatgcgtgaatctcagcgtcgttgtgtaactgcttccgactatgaggcttttgtgtctagccgttttggtagtattgttcaggcggtacaatgtttcaccgaccgagaaaaaccgggttatgcttttgttgctgttaagcctaaatctggcttgcgcttgacaactgttcaaaaagaagatatgcgggattatctggcaaaatataatcttgcccctatcacgccgagcatcattgaccctaactatctgtatattaaacagaatattaaagtttcctattcaatcaatgacttgtcagaatcagagcagtggttgcgcggtgcggttattgatcagattgatgcatattataccgacgaagtggaaatttttaaccagacctttagtaagtctaaaatgcttgcgcgtattgacaaagctgatgtatctgtgataggttctagtgcagaaatcgagatggtgcgagagatcgacaacttctataaagcaccgatggctggaatcaagtttttaaaccagtataagagcggaatcaagtctagttcattcaacttcgaaaaggacgacaagcaatatccgatccattatgtaagtacagaaatgaacaaagaatccggtttagctaaattgctggttggacctttccctgttgattctacaatcgctttaccgcactattccggcactgattttgataaagaggttattgacggtgcggacctatactttgaggttggagaggttcagcattatgacgaccttatttcatgggatctgggtaaactgaatatcaatagcgatcgctttactggttcatatattgagttgacagctaaaccgattgctgataacatctttactaaagacggttctttgatcgtgtttgaaaacgatctccgtcctcagtacacaactattagtctggaggcaattgctcaatgattaaagcgcctagtgtaactagcttgacaatagaaaaattgtctgataatcaggcgtatatcacatgggatgacgtaggcgaaaacttcttttattttgtggagttagccgaaaccagaacacgagacggggagatcatccccgtcgatgagttaagctgggtaaacctgggatatactgccgaacaaaactggtttgaggataaaaacctttttccagaatattattacaagtttcgtgtagcagtagccgcagaaggatttgaacaaagtaaatgggttgagacagaagagtttcagacatttaaaacaaacgcatataatttttctatgatgcgagagttcaaccttgcaaacgagtttataaaggaaaaatttacatacgataatcgagagtatgtcaagtttaataccgaccttattcaagcatcattgatgaaggaagattttgtctttagtcctgaatatgcaaacatgacaaatatctcaaactacattgtagttgatgagaactttcatgaaatacaggaccacatagaaaaagtttgtactgatataaaccgcactatgttagcggaaatgaacggtgttttgtaccttttcgaacggttccagccgatcgtgaaagtgtcaaatgataaaggtcaatcatggaaagcatacaaggcttttaatgatcgtgtaggcaatccggtttcccgcacatgcgtttatcagtctaaaaccactacttacgttttaggatatgaccgaatcttttacggacgacaagctagcgatactcgatggagcgcggacgatgttcgatttagtgatgatacgatcacttttgcaaaggttggtgacgagaacgatttaggctttgacgttgaggtctttggtgtattttccagattaacaggtgataccacaaaatatgccgaagctatggcgtgcagtgatgactatttgtgggttggtgctaaagatgttattcgccggattcgtcttaagaatactcctgttgataccgtacagggttcgcctacgtttggagaaaaaatattcgatcctgatgttatccgagtaacaggaaatgataaagctgtcattcagaaaatggatgttatcgacggtaaattgcttgtatttgttacgggtgaagttaaacagcgttatcaagatccaactaaaccagaaaacgttgttccgtcagatgatgcgggtgtatacttaatagggagtgatggtctgtcttttcagagagtatttggcaacactccgcaggaaagggaatatattcagcatgggttcagtaatatgtcaaccaatggtgatgaggtgttcataagccattataatcatcacttcgaaagcattttacctgatccagaaactgccgcgaaatatgaattgggcgaagctgtaaaatattctcaggagccaacttatctaactgataagaaaatacatcaaactactttcagagcaagttatgatgatttgcgtatttgggagttaggaccgcaagcgtattataatgaggccgattatacatggatgcgtcgaaacggtgtccgtgtgtggatcacaaatgataatcgcccgttggttgtttatccagaggttatctatactcaagaagttgatacatctggcattcttgaccaaaataggatcaaccgagaagtttatgataaagggaccgtgacctgttatcttaacaatgttaaatttgaaggattcaaacaatatgcatccggtgtaatgttccataaaaacacaggagagatcataggattctatcaatttaattatcgtgttcgtgatcaggttggtgtatattggaaacctacaaatgtagcatttgttgctgaattgcaaaatcaggttcgagaggttccctgggttccggttcactacgatcgagagcaagatccagatttgcggcctttactgaataagatgacccctgatagctttttacttgagaacgaaaatttcagaaaattctctgaatattatctgcaattcttaagcgatggttcaggaacatattataataaactaaaaaatctgattaaaaacaaatatccacgcgagcaagatgcatatgagtatctttggtcagagatgaacaaacgaaacatctatgcagataaaaacaagcgagatgcggtcgtaagattcttcgaatcccgcaaatcagatttttattccactaagggcgtggaggcttcttacaagttcttgtttaagttactttataatgaagatgtggaaattgaggttgaatcacaagccggactagagtatgatattgttgttagttcaacgaacattgacgaggatatcgtaggtcgcacgatctatactccaaccggacgggctaacgtgacttatcttgaaagggaatatgaaggtggacgtctacgctggcgagtaaccattcataacctgatcgggcggttcgaagaaggtcaagtgatcaaatcagagaaaacagcgtttgaggggatgatccttgttggtgtacgtggtaaagagttgttgagtagttcaatcgactatatcaaccgctcacgaagccaatacaccatgaagattaaaagtgcattgccagtttcgcgctatgcaaatgatgtaatgcgattcgttcatcctgtcggctttgggtttatcggtgttaccctgcttacgatgttcattaacagcgggttgagcatgaagcacaccgagactataattcaatctctgaaaaattataagtttgacagcggattgcctagcgtgtatcctgatcgggtggcagaccttgacgttgacggaaacattaagaaagacccgcttaccggaaaagcattatacttaacgtcaccgacaatgggcgaagagttccccgttcctcctgaatatgatcaggagaacagcgaattgttccacggacttaaagcaagcgaacgaagatttgcaatgagtccactgtttgaccagtcggcggtaacattctctatgttccgtgaacttgtagataaacggttgaaggataatatagggaatccacgcgatccgaagaatccgacacagaggaaaattaatggctaatgaaaatagtgtgatctatcgctcaatcattactagtaaattcagaacggaaaaacttctgaatttctataattctgtaggcgatgaggcaaatcaaattacaatttatggaacgtttggacgttcggagccgtggtcagaaaacgaaaaagaggtgggctttgccccaccttatccgaccgattcaacggctggtgttgttgacatgtggacccatatgatgggggcggttaagattaacaaatcacttcttgatgcggttatccctcgtaaagattggggtgataccggacaggataacccgcgcacattctttatcaatgacattgttgttgtcaactcagcaccatataaccgaactgatgttggtggcggctggatggtgtatcgcgtaaccgatgttcctgatcgcggttactgctcgatttcaagcattgacgctaaagtagagtgtttgaagttgggcggaaagtggacccccactcatgaatcaattgcgccacctgtaggaaagggcgattctattgatatgggtgatgggtatcgttgggaatatctgtacacaattccacctgatgcggcgatcaaccgttgcaccaatgaacatattgttgtaccgttccccgatgaactgcgacaagatccggcgcgttggggctatgacaatgtgatcacatggtataatgactataatctgctttatcggctgaaagtagtaactttgcgttttcaggcttatatggactctgcgcaattcccaactaccgcgttagtgggtaatactggtttccgtcagttaagcattatccttaacccattggaaaagaaagcacgccctagcgatccagacgttaaagcggttaacgataagtaccgaccgcaagacttagagccacactcaggcgaaatgatctatatggaaaacagacaacctatcgttcgttcattagatcaaacagaacttgtttctgtattgtttgagttctaagtgtatgatttaaaagccaattcgagagagttggctttttctgtttttggtgttgacaatcttgtctggtaaggtatataatgctcacatctaaacaacggaggataaattatggcacgtcgtaaatttacagataattgtgaagcaattcaggtatccccttgcggttgggatgtgatcgcgaacggtgaaaagatcggagagatcatcgatcatactcattcatcattagccgattacaccgatgaactatgggagggtatcaacttcatgaatgacactaaacgattcaagactatcgacgaagctatctattttgtgtataatccaactttcggtatgtggggaactagaaaatggcacgcgtaaatattaaactgcattatacaatgggtaaaccaaaacatccaatgcataaagtgttttggggcttgcatcttcaagaaaaatggcatgataactattggttttgtgaccatgataagaagtggcattctcaagatgaagttaatgcgatgatggaacagggtataaaatttaattactctaattatgaccatagcattacttgtattcgaaaattgaaacggtttattcgaaagaatccgcaatttaaaaactttgtgttctttatgtctcatgtttatttgggtcatagcgttacagtaacagcaaaggttaaataatggcacgactttctaaacaagaacaaaaattacacgatcgggtgatggagttgattaattcagatcgcccattgacatatgaagaaaaagaattttgctataataactatcatggcgatggtctaggcggttcaggtgcattctttaccccagaagggcttgcatgggattttaccatcgatgcacattgcacaggaaaagtattagatctttgtgctgggatcggtcgcttatctttttgtatgttacatcgttgtaagccagaaaagatcgtatgcgtcgaactcaatccagaatttgcgcggattggcaagagactattaccggaggcagaatggatcaccagcgatgtattcgaatttgagtcaaacgaaaaattcgatgtggtgatcagcaatccacctttcgggaaaatcaatacaaccgacacaaaggatgtatttgagtacactggcggcgaatttgaatttaaggttatgacattaggccagaagtttgccgatgttggctattttattgttcctgtgggttccgctggttttgcttattccggcagaccttattatgacgggaccatgaagtctaataaatatctaaaatggagcaaacaaactggtttggtgacttatgccggatgtgggatcgatacatcaatctatcgcgatgaatggcatagtaccaacgttttaacagaagtggttgaggttcggtattacgagaaagaagccgtagaagcgcctaaatcacgtcctaacgaacaaatagaagaaagtaaggagattaccttaccgaaacaggaaagcgagtctgggacgctctcagatttgtttgacatttaattataagccgtccttgtgggcggcttttttgtatgtattttataaataatacatcataacatgaggaattaaacaatggcacaagttccaaagaaaagaatagacacaggtactgtcggcaatcccagcaccggggacatcctctatgacggcggtaataaaattaacgataactttgattcaatatatgacgcatttgctgatcagcggtttaaagacgtagaccacggcgtaggaagaatggttattcatgcaaccggatactatcagaaacatccacgtcaaagctacgctggttccgctgttgagattgggagtctacacgatatcgatacaactcaaggcgcacttattgctattctacctaaagcaaaggtcggcgagggtgttgtattcataaatagtaacggtagcttttcaacgacgacaccgctcaatattcgaactcaagcaggtgattctattagcgggtattccggtgatgctacaataacacaaccattttcaaaagtcactgtttggtgtactgccgttgaaggtagtcgcgtaacatggcgattgggtatcgaaagtatgtttaccgatacaacaacgccattagataaaacagttaacgtaactggagtagcaacaaacgttgctattgccgcaaaaacagaatacgtttccatcaaattattaactaccgctagcaatacatccggttcaaaaatgcgttcaagtgaaacgctactgatgattgattctaaagccggaaaagtttatgcgacggaatatgcagttttgcagaagacagaagatgaactatacacggttcgttatttcatcggttccggcgataaagtatatgcagagtataaggctactggcgaaaatattcgtttagcagttaaagccgtagacactattaaaatcggggttgctacatgaaacaattaattaatatcggtaacgttgttgatgacggtacaggtgattatctaagaaaaggcggtcaaaagattaatgacaacttttctgaactttatactaagctgggggatggtgatatccctcatgcatccggcgcgtggaaaactcacacacaaccagtattaaaaccaaattttggtgatgcatgggcgattaatacaacgaacaacgctgtttctgttgaattgcctaaaggaagcgcgagcgattataataaaacaattaaacttcgtgatgtttggcgctcatgggctgcacataacgtaacgttgaagccagcacaaggtgataccattaagggatctccaatcgaccgtgagttgtataaagatttcatggatgttgaattggtttattgtgcgcctggacgttgggaatatgtcgaaaataaacgagtagatactatcaccacttccgatttaagcacagtcgctaaggaagtttatattgcaaccgaaggacaaacagacttccctaatgtgtttggttccaatacttacaatattcgaaatgttgaagtgtattatcgcggtaacttgctttattatggcaaggatttaaccgatgattctaactatggttcaatcggtgaaaacggtgatattgttcctcttgacggtaaaagcattaaattacgcttcccttgttcggctggtgataccattcaaatcatcacttatatggacggtatcgcatccttccggtcaagctatattactcatacaatccgcgtttatgaaacaggaatgaccactttggaatccatccccggtgaagtttgggttggtgaactcgctaataagaaagaatttactaatgctgaattaggcgtaagtaagcgagatcttattaatccaaattcatttgaattgctgatcaacggcacacaaatgattaaagcgggtgatgcggatttaccttcctttatttgtgaaggtgctgacggtgaaacggaagaaacctgcgtacttgctggcggtcaatgggtggaatctggggaagattattcattgatgttcgacgaaaacagcgtggtgactggcattaaattatctgaagcactagataaccgagatactatcacaattcgctggtttaataatgatatcggaacattaatggaatgggacggtgtaggcggtattaaagaaaaagcagataaaatctatcttaataacgaagatgaagttactctgacaaatcgaattgaatataccgatttccaaaatccaagccaagcgactaaacgcccaatggaagattatacaggtcgtgtgatggatatctattccatattcgatattttctatcctataggcacaatttatgaaaatgcacataacccagctaacccagcgacctatatgggatttggtacatgggtacgttatgcagaaaaagaatttttagttggttggtcttctgacgcaagcgatcaaaacttcgcactaaacaacaacgatcttgatacacatggtcaacctacacacaccgcaggtggtaatggtggtgatgttgcataccagatcaagaaaaatatgattcctgaattacagagcgacgatcgagttcttgtaaaagatgataacggaaatattattatcggtggttgtcaggtagaccctgatgcagtaggtccagcgtttaccaaatatcgcgaagataatgttaaagttaatcagggaaataccgacccgtcaatgattggtattcttcctccatatagaactgtctatcgttggctaagggtaggttaatatgatttctaaaacacgttcaaaagctagtgtattttccagcgatgcggcgtttatttcatacgatccaggatcgaaagatcctgttatcggtggttctcgtccaattggtggcgttaatgtcgatcaatcaagaaaaggttcctatgtaaacaacgttcaatctgcaattgatgacctttattcattgtcaatgatccgaattggtgatgtgttggttacaaccaactcaactccaccacaagccgcaggacagattgaaactctgtcattttctggttctgttaacaatcagcataatccagacgcaaacaaagtattaattgatgttttgggttatccatttattgttgatgttgggtcttccggcgtttctctatgtgagaaagtaacggaaaaatttaccgaactaatgaataaaaacattatgttcaaagaagtaaaaagaaaaggaagtagcaacgaccaattagaaattcattatatcgattctcttgaacacccaccaaccgatattaacaagtacggaattacaatcacaggaaatgttgattctcctgctcgtgttggttatggttcatggtctcgaatgggtacagaagagaaatttggaactaccctatattatttcaaacgtattgcataaggtgatgtataatggcaaacaatactattaaccatgtaaaagacgatgctcaatacgtcaagtttaaccctgtaaatgattggcctcaaagcattaccaacgtacaagcggctttagccgctattaatggctttgccgtaaatggattaccggacgctacggaagatacggccgggatcgctgcaatcgcaactcaggaagaagtaaacgacggcactgtagacaataagatcgtgactccaaaaacactagctgttaaaatgtcacgtccagatgctacaaaagaagtaaaaggcattacccgatttgccacgatggaagaatcgctgcaagagagcaacgagaacatggcaatcggtccagacacactaaaccattacttcaccactaaaaaggcgtcagagagcgttcaggggactattaagatatgttctcttgaggcggcaaagattggcagtgatgacacaatggcagtaacaccgaaaaagatgcacactgccattgcacagattgtgccgggattaattccagatcaaaacacagcaaccgaaagcgcacagggtttagttcagttagcaactaatgcgcaggttttacaaggccagattcgagaaggttttgcaattagcccttatgcatttgcaaatgctcgcgccaatgagaatcaggcgggtactgttaagatcgccagccagtcacagatgaatgctggttcagatgatactgtagttgtttctgctaagaagtttgcaagcactaaggcaacaacgtctcaatacggcattgttaaactacgagacaccgtaggaagtgaggctaacgctgcactatcagcaaatgctaaggttcttcctagcactggcggtacggtaagcggaaacgtctataaaggttcaaactcagacggcaaccagtttgttactaaaaatgaattagcgaatcacgcaatgccaattggtggtattatcctttctggattcaatgccgatcgaggtgactttctgatctgtaatggtcgttcactgaataaaaatcaatatccgcaattattttctgcgattggttatacctttggtggttcaggtgacaattttaatcttcctgatatgcgcggtttagttgctcgtggttgcgatcatggaagaaaccttgatccaggtcgtcgatttggttcttatcaagaagacgcaatgcagagaattactggtaaattccctgtagctgaccgctggcgcggttggtatggtggcgcatttactgcacagcgcggtcaatggagcacgaactataaaaacggtggtggtgatgattggggttctactgttaactttgattcaggaagatccgtaagaacggctaacgagactcgcgtcaagagtctggcattaaactatatcataagggtgcgctaatgattgaacaattaaacatccacgagatcccacatgttgacggtgtaccaagcgaaggacagcaccgtattatttggatcaagaatggcgaatgtttaagcgcagcaacgacacagactggcaatgacgggacgcttaaccgcgccccggttgcaattcaagaaaacgttgcacgcgtaaacgaaaacgcaaaatcaaccgtcgctaaagttaacgaggttgtaacggcggttaacgatattaaaacaactttaggggtaatttctgacggaagtatcattgatgtggttaaccagactgtcgcaaaagttgaatccgtcgaagagaacttaggagaaacagcaagaactctacaaacaacggtagacgctgtatcagaacttaacatcaagattggtgatcgccccgctgccgatccgagcacaagaacaatctatgatgacatttctttcatcaaacaagaaatgggttcttatcctaactttaatatcaatggttcccctgatgctggcagttccggttctggcatcaaataccgagttattcagaataccgcagcattaaatgaccacggtcgccgaatcgttcagcttgaaaacgactggcaagattctgacgtaggcgagttaacaagacaagttaacaaaatgcgcagtgagatcggcgacacgtctcttgcaacacaagaaaatgtgtatgttcgtctccgcaccaacgcaagaaacattgctaacttatcaaacgaagttctagaagtcaagaaagcaattttgtttgattcaatccctgatatcgggactaaagtcactacgctgggaactaattatgaacgtctaaacaatgatgttaatggtgtagattccggtattcgtcctcgtcttctggctgtcgagaataagatcggaacgcctcaatcggctggaagcattgactatcgattaaccaacacagagcgagaatttttagatcttaaacaggttgttggtgtaagcggtgctgacggtttgcgcggtgaagttgttcgactttccaatgagattggcactgacagcgatcgacatactctagccggacgtattaaagttgtagaaaacactcagggtcggttagaagcaagcgtacaggacatggaacagcttgtaggtgatcgcgaatcaggtttgaccgctggcgttattaaactatcaagtgatatctatggcgatgatggttcagaagatccatttactcagaaaggcgtgattaaaatcgtcaaagagctacaaacatctaacggaaacaaagtagatgatgtacctgatgacggtttccattatctgcgtaagcgcggagaatgggtgcaagttgcatatgctgctggagcatttaaaaataccgcagatattacggttgaacttgacgaacaggatgtttataaaccgattccgcttaacgacatggcggaagaagttaatgcgcgtcaaatggtgaaaagtgaatctgttgttaccgttcaggacaaaggtttattccgttgtgtattccgttgtgctgtacaagctcaacataatgcaacattcattgttgcgattttcaaaaatggacagatggtatatgaagcgaaaaatggtcattacggcacagacgaattgatcagctattctaccagtgctttcctaaatattgaaaagggcgatcagattaacatccgtattaagggtgtatctgtcgaagcagtatcacaaccagtacaaattaaagagttcctctttgggatttctccggtataagaaattaaaggggcgttaagcccctttttcgtttataggtgatattatgtcaggatatgtaaccaataacccaagagaattaaaagacgctattctgcgtcgtttaggcgcaccagtaattaacgtagaagtaacagaagaccagatttacgactgtattcagagagcattagaactctatggggaatatcatttcgatggtgtgaataaaggatataaagtatttcgtgttagtgcagagcaagcgcaacatggggtatttgatttaagcgattctggagtatttgcagtaactaaaataattcgaacaaacgtaggtagcgcggctacgatggatggcactgccgtttatccgtggtttaccgactttctgttgggtttagcgggtgtaaatggcggtttaggatctggctgtagtaaattttatggtccaaatgcaatgggcggtgatctaggatatttcgaacagcttatgagctatcgagccactatgcaaaatatgctcaatccgctgccagattattggtataacagcgcaaacggacaacttaagataacaggaaacttccgagaaggtgatctcattgttgttgaattatatgttaaaagctatgtagacgttcctgatatgatcggcgcggttgctggttatgcccatgcaggaggatgttctaccgctggcgggattagcgccgtttatgataatccaactgctggtttaagcgggattgttgctggcatgggaccgatcagtgagaacaagcagggcgcatataataaccgttgggttaaagacatggcaacagctttcactaaggaggtgtgggggtccatcatggctaaacatcaaggtctgcaattacccggcggtgtcactgttgatggtatccgaatcattgaagaagcacgcgccgacattgagaaattgcggcaagaactagaattattagatcctccgttcggcatcctcatgatttgatttattgggggagtattcccccatttggagtaacatatgtttaacaacactctttttgctcgccttgaatcgcaaaaggattatgagaatacacgacaaacagagattcttaatccttatgtgaactttcacaaatatacaaatactcagacgttagccgacgttatggtcgccgaagctattcagatgcgaggtgtagaattatattacatccctcgtgaatttgtcaagccagatatgatctttggtgaggatgttcaaagcaaatttactaaagcatggaaatttgcggcgtatattaactcatttgatgggtatgaaggagcgggtaatttcttctctagtttcgggtatcaagctaatgatgaattaacttttacggttaaccccaacctattcaaacatcaagtagatgatcaagagccaaaatcaggtgacttaatttatattccgatgagtaatgatttatttgaaattaattacgttgagccatatcagccgttttttcaggctggcaaaaatgccatgcgtaaaattattgcagagaaattcgtgtatagcggtgaggaattgcgaccagaattacaacgcaatgagggaattaatgttgatgagtttgcggatctggatcttgcaccgatcactaatctggacgggttaacagatatcaacctagatcagtacaaagaagataagcaattcagaagcgaaggacaagattttattgatccgtttgatcctattaatggcaagggttcacctttcgccgatttttgataaatacttgtattgatataatataaggatctaatgacttatgaaaaactattatctatacgaaataaagaacaatataaatggtaagatatatgttggcattcgtgggtatgatggtgacataagtcaagatccttatatgggtagtggattgactcttaagaggtctattaaaaagaacgggatagaaaacttcacaaaaacaattctcaaaacgtttgactcatggaaagaggcaaggaaagcagaaagagaaatagttacagaggaatttgtaaaaagagaagatacctataatgtttcggttggtggacaaggtggaaatactcacgctgggatgagcgaagaacgaagaaaacttgcaagcgaaagacacgcagaagcaaaccgaaatagagtatggaagcaagaatctagagataaggttagcgcaagattcaaaggtcataagctatcacagaagcagatagacgcgctaaagaaggcaaacacaggaagaaagttcacagaagaacacaagttcaaaataggtaaaacgtggcgaggaaagaaacgaccagatataggagagaaggttgcggcaaaattaacagggagaaaactacccccagaacatgtggcagcaataacgcaaaatacaccgagaggaaaacaacactttagggcaaaaagattcttcatcgacgatatggaattttatattttgagtgacgcagctaaaatgtttggtataagttataaaacggttaaagctagacttctctcagataagtttcctacatggagatatgaataaatgttttcacatttttacaattcgtcaattagacggtatattgtattgctgggtaatttattctccggcgtacaaattaaaagggtgcgtagcgacggtgagcgttttattaaagttcctatcacctacgcaaagaaagaaaaattcatgatgagtctggacaaatataacaatatctcaagtgaggaagacgtagcaaaggtagaaactattttaccgcgtatgtgtctttctttgattgatatgacatacgcccagaactttaaaacaaatattgcaaataagacagtaccaaaatatacggctgatggaatcaggagcgtaacacaatataatcctgtaccatataagtttactttcgagttagggatttatacgcgtaacgaagatgatatgtttcagataattgaacagattcttccttacttccagcctcattttaactgtaagattaaagaactacacggtaatgatgtatggattgatcgagatattcaggtcactattagttctattactccagatgaacaggtaggcgaagataagttttctcgtcgtcgtcttgagtggaccattatgttcgaatttatcgggtttatatatcctccagctaccgacgttaagggggaaattagaacgatttatcttgattttcatgctaattctcgtgaattaaatcctagcggtaattttgaatcagtggatcacgaggtcgttaaacgtgacgtcgagcaagaagattgggacggaacaatcaaagaatcatattctagtgatattccaataccagttgcaccaactccaccgggtccacgtattgtaagagaattttaagaggtattttattatgtcagatctaggcttagatatgaagcaattaatgaatttcgaaagtctaggtcttccggggtcattcgacgcggaagaagatcgagtgagctatgatccgctcgtcttgactccggtcgaaagtcatccagaagatcgtaatattgacttacaacgagattataatgaggcacgtcagaatattcattttcagaatcagatgatgatggacgccgcaaagatttatcttgaactggcaaaaaatagtgagtctccgaggttcctacaagcatttaacggcctcatgcagcaaatgagcaacaacaataaagaattgctgaacatccataaggatatgaagaaaatcaccgagcaagctggagagaaaaagaaagataataccccagccgcaccagttaatatccagaatgcgaccgtctttatgggttctcctagtgatttaatggatgaaatcgaagacgaggaagcgcgaattattgaaggtgagacagtatgagcgtgattgaagggattaacgcaatggcgacggatgaacacccgctacatttagcgcatccgtctacactagaaaataaaattgattcaaacggcattgaatggattttatcaaagcatgatgataaatggtatcctaaaaagttttctgactatctgaaattaaacagaccgcagaaaataaggatgcaaagcactgatccaacaaattataagttctttaaagatagtgacaatattcgcacgcggtatatgcgattaaagaacttgcgaagggcgaatattaaaactcagtatacccctgaaatgatcgcagagtggaaacgatgccgtaaagatattgtgtattttgccgaaacctattgcgcaattacacacatcgactacggtacaatcaaagtacaattgcgtgattatcagaaagatatgcttaagatcatgcatgaaaaccgcatgagcgcacataaactcagccgtcagctagggaaaactaccgctgtagcaatattccttgctcactacgtttgttttaataaagacaaagcggtaggtatactggcacacaaagggtcaatggcggttgaagttctagaacgtactaaacaagcaattgaactattaccagacttcttacagccaggtattgttgaatggaacaagaaatcaattgttcttgaaaacggttcaagtattggtgcttatgcgtcgtctcctgatgctgtgcgtggtaactctttttcgtttatctacattgatgaatgcgcatttattcaaaactggacggattgtttccttgcaattcaaccagtaatttcttccggtcgtgaatctaaaatgatcatgaccacgactccgaacgggcttaatcacttttatgatatctggcaatcggctattgatggtaaaagtggttatgttccatatgaggcggtttggcattctgttaaagaacgtctttacaataaagctgatatattcgatgatggttatgagtggtcatctcaggcgatcgccggatctagtcttgagcaattcttacaggaacataacgctgaatttttcggtagttccggtactctgatcagggcaaccacactatcaagattatcctttattgacgttgttaatgataacgggttttatcagtttgagaaaccgaaagaaggtagaaaatatgttgctacactagattgctcagagggtcgaggacaggactatcatgcattgcaaatcattgatattactgaatttccttataagcaggttgcagtatatcacagcaatactacgtcacattttatactaccggatattgtctttaaatatctcatgatgtataacgaatgtccagtttatatcgagctaaatagtacgggtgtatctattgctaagtctcttgcgatggatcttgaatacgataatattatttgtgactcattcatagatctagggatgaaacaatccaaaaggtctaaagcaatgggatgttcggcactaaaagacttaatagaaaaagataaactgatcattaatcataaaggaactattcaggagttgcgcacattctccgagaagggggtaagctgggcggcagaagaaggttttcacgatgatttggtcatgagtctggtaatatttggttggttaacaactcaagaaaaattcgccgaatatgcaggaaaagacgaaatgcggatcgcctccgaaatattccgaaaggaattagatgaattgggggaagaatacgcgcccgtggtaatatatgacggtgcaaacggcatcgaagaatataggccgcgtgaaggtctaacaatgatataaatacgataatgcataaaaagatgaggaaattctaatgactctattatcaccgggtttcgaaacgaaagaaactactctctccactaccattgtgcaatctgcgactggtcgcgctgcactggtaggtaaattccaatggggtccagctttccagattattcaagtaactaatgaagttgaattagttaataaatttggtcagccggataataacaccgcagactatttcatgagcggggctaacttcctccagtatggcaatgacctgcgtgttgttcgtgtattgaataaagaaaaagcgaaaaacgcaactgccctagctggtaacgtcgagtttgaaatcacaaacgaaggttcaaactatgaagtaggcgataccatcaagattaaacataaccgtcaagatattgaaacggctggtaaagtaactaaagttgatggtgatggtaaagttaagggcgtatttatcccaactggtaaaattatcgctcacgctaaagcaatcggtgtatatccagaacttgatggcggttggacggcagagttcacttcttcgtcaggtaacggtagtgcggcgctgtcagtaactaaaattgttactgattccggtcttctgttaacggatctggaaacttcccgcgccaatatcacaaatcaaactttcttgactaaactcaagaaatatgatatgccagcggtaagcgcgatctatgctggtgagattggaaactcgctggaagttgaaattctggcgcgtagtgcgtttaagaacactgcaccggatctgaccatgtatccttatggtggcgagcgcaccgcagcacgcaacctgattccatatgcaccgcagaatgataatcaatatgcgtttattgttcgtcgtgatggtgttgtggtagaatcctatgtactgtctactctgaaaggtgataaagacgtatacggcaattctatctatatggacgacttctttgctcgtggttctagccagtacatctatgcaaccgctcaagggtgggtagatggtttcagtggtattatctctcttgctggtggtgtttctgctaacgaagcaacgactgctggtgttggtgctgatccgttcatcggtgcgatgatgcaaggatgggatctgtttgctgaacgtgaatctattcacgtaaacctgttgattgctggtgcatgtgctggcgaaggcgatgcgttctctaccgtacagaaacatgctgtttccatcggtgatgagcgtcaggattgcttagtaatggtttctccgccgcgtagcactgttgttaatattccggtgactactgcaattgataacctgattgcatggcgcgaaggttcaggaaactataatgaaaacaacatgaacattaataccacttacgcggttattgatggtaactacaaatatcagtatgacaaatacaacgacgtaaaccgttgggttccgttggctgctgatattgctggtttgtgcgctcgtactgatgctgtatcccagccgtggatgagtccggcaggttataaccgtggtcagatcatgaacgtggttaaactggcaattgagcctcgcaaagcgcaccgcgatcgtctgtatcaggccgcaattaacccggtgatcggtgctggtggtgaagggtttatcctgatgggtgataaaaccgctacgaccgttcctagcccgtttgaccgcattaacgttcgtcgtctgtttaacatgctgaaaaagaatatcggcgattcaagcaaatacaaactgtttgaaaacaacgataactttactcgcgcttccttccgtatggaggtttcgcaatatctcagcacgattcgctctctgggtggcatttatgacttccgagtacaatgcgacaccacgaataacacgccggatgtaattgatcgtaacgaatttgttgctagtatgttcatcaaaccagcaaaatcgatcaactatatcatgctcaatttcactgctgttgcaactggttctgattttgacgaaattatcggtccagctaaccaggcataatcagtaaattagcatagattaaaagttaaatcaagcggggagaaaatccccgctctattaaggaatatcaattatggcactcgatttgaatgatattacacgcggtttcgagtctggcgattttgctcgtcctaacctgtttgaagttgagatcccgtatctggggcaaaactttaagctgatgtgtaaggctgcgactgtcccggctgctaccgtagaaaaaattgctataggctatcaaaaccgtaaaattaacatcgctggcgaccgtgtatacgacgactggaccatcactgtattcaacgatgacgcacacaagatccgtgatgctatcgttgcatggagcgatcagacacacggcactggttcggcgatcactggtgcaactcctgcacaatataagaaacaagctattgttcgtcaacttaaccgtaacaccgaatcaactagcgaaaaaacattgcacggtattttccctaccaacgttggtgaagtaaccctcgattgggaacaaaacaacgaagttgaaacgtttgaagttacttttgctatcgattgggtagaataaatatattatcatgcggggagaagttccccgcctaatttctcccaattcgaggtgaataatgtttagtagattaaaaatgcttgcgcgttgggctgattttgacaacgacaaatacgaagaacaaattaaagataaagcagagtctatcgccgcacctaaaaacaatgatggtgctacggaagtagaaattaacgataattcacctgctagctcgtggaactctcttacccagcaattttacagcaccgaccagaaaatcagcacaactaagcaattagttaacacatatcgcggtttgatgaataaccatgaagtcgaaaacgctgtacaaaatatcgttaacgatgcgattgtatttgaagaaggtcatgaagttgtttcattaaatcttgaggcgactggctttagtgaatctgtaaaagagcgcattcatgaagaatttaaagatcttttaaacactatccagtttgataggcgcggtcaggatatgttccgtcgctggtatgtcgattcgcgtattttcttccataaaatcatcggcaaaaatccaaaagatggtatcgtagaattacgccagcttgacccacgaaatcttgaatatgttcgcgagatcattacagaagacacaccggaaggtaaaatttataaagcaacgaaagaatatttcatttacactgtaggcaatagctcttattgcgcaggtggtcaagtattctctcctaatagtcgcgttaaaatcccgcgtagtgctattacatacgctcacagcggcttgatggattgcgatgataaatatatcattggttatttgcatcgggctgttaagccagcaaaccagcttaaattgttggaagacgcaatggtcgtttatcgtatcacgcgtgcaccggaacgccgagtgttctttattgataccggaaacatgaacaaccgcaaggctgcacagcacatgaactcagtggcacagtcttttaaaaatcgcgttgtttatgacgcatcgactggtaaacttaaaaaccagcaagcaaatctatcaatgacagaggactactggttacaacgtcgagatggtaaagcaatcaccgacgttactactttacccggtgcatccggtatgagtgatatcgatgatattcgctactttaaccgtaaattgtatgaagcgttgcgtgtgccattgtcacgcagcaatctctccgatgctaatatggtgatcggtggtgatggttcagaaattactcgcgatgagttggaattttcgaaattcattagaactctgcaatcacagttttcggaagtattgcgcgatcctctgaaatataatctgattctcaaaaatgtaattacggaagacgattgggatcgtgaaataaataatatcaaggtggttttccatcgggactcttactatacagaagttaaagacgcggaaattttagaacgtcgaatcggtctaatcgaacgtattacaccttacattggtaaatatttctctaaccagacagtgatgcgtgacattctgaaatataccgatgaccagatggacaccgagaagaaacagatcgaagaagaagcgaacgatccgcgctttaaacaaactcccgatgaaatagaggatttttaaatgaaacaatttatcgaagcaattaaaactcgcgatctaacgctgatcgaaaaagaatttgataagatcatggaggctaaaaaagcccagatcatcgaatcccagcgtgtcgaaatcgcatccagtatcatgatcgaaggtgaagaagaaaaagaccgcgatgatgaagaagatatggaagatgaggacgacgaagacgaagatcgcaaagacgataaaaaagacaaagaagacgacgaataataggaagccaacatgattaaagattttactcctaaagctgacttagaaacttttctgccggaagcacaggaaaaattggacatgttggctatgtttgagtcagaagaactattgaaaatcgttgaaggtatctccgaggatgagccggaactggcggtagcaatgctgtctatcatcgacggaattactgtaaatgaagcaatggttaaacatgtaaacgcacgcggggaagttgcacgtaagaaagatcgcaaaacccgtgagcgtaatgcttacatgactactggcctaagcaaagctaaacgccgtcaaattgcccgtcgtgctgcaaaaaccaaacgtgcaaatccatctatcgaacgtcatgcggaacgtaagcgcaaaaaagcaatgcgtaaacgtaaggcgttaggattataacaggaaacaacatggaaaagaacgaattactgatcgaacaatggggcgttccttgtgctcgcggtagttcgtcattgcttgaatcatttgatgataaggctacaggaaatctctatattcaagggattttcctgcaagccgaaacagtaaaccgcaataaacgctggtatcctcgcagtgttctagaaaatgcggttactaaatacatacatgaacaagttgagacacatcaagctctaggcgaacttaatcacccagcaagagcaatgccagatccatctaatgcgtgcatcataattgaaaaattatggtgggaaggtaataacgtgatgggtaaagcccgtgttattgaaggggataaaggcgcaggtgataaacttgctgcactgattcgcgctggctggattcctggcgtttcctcccgtgggttgggtcgtttaaaagactctggtcgcggatacaatattgtacaggaaggttttgtgttgacggttggtgttgatgttgtatggggtccgagcgcaccggatgcgtgggtaactccggtggttgagtcaacggataacgattctagcgcgccagacgcaccagaaagcgataaaaccgaaaaagtgactaaccctacagcctcacaacaaaacatcgtagaatcgaataatagcgcgtttatggcgctcgcagaagcgttatctaaacgctataaataataacgtcgttatcaacaagaaggttataaccatgcttaaagaaatgctgctcgaagaagcaaaacagatcaccgtagacgttgctctcgatgacctgtttgaatccgtcgaagtgtcgccggaagtaaaagaaaattttggtactatctacgctcaggcggtaaaagctaatgctgttgctctggcagaaagccacattgaaaaaatcgccgctaaagccgatgaactggtagaatcaaaggtcgaagaagcacgcaccgagattgaaaccaaactgtacgaagatgcagataaattcctgaatcacttaggcgctaaatggctggcagaaaataaagaagccgttacccgtaatattaaagcggatctgtgcgaatccctgattggttctctgaaagatgttttcgttactcacaatgttgtagtaccggaagaatctgtagacgttgttgctgaacttgacgaagcactcaaagaagaaaaagaaaaaacctctgaactctttgatgccaaactgcaacttgaaagcgaaattcgtggcatgaagcgcgaacaagcgatcaatgaaagcactcgtgatctttccgatactcagaaagaaaaagtaaccgcgctgattgaaggactggaatatagcgaaactttcgataagaaattaactgcaattgtcgaaatggttgctaagaaagaagacaaaccagcgaagattgaagaatcactaaatactgatgccgacaagctgaatgttattgcagaagctgtcgaagaatcagagaaaaaggcaactgtagattccggcgtatcccgctacctgaatttcatctaatgtaattcaaatctactttataaatactttaggttaacaacaaacaaggtttaaagaacatgaaaactaccaaagaactgatggaaaaatggtccccgctgctggagaacgaaaaactgccggaaatcgcaactgcgtctaagcagaaactggttgctaaaattctggaatctcaggaagcggattttgctgtagacccgatctataaggatgaaaaagttgttgaagcattcggtggctttatcgcagaagccgaagttgctggcgaccacggttatgacgcatctcagatcgcggctggtcagaccactggtgcaatcactaacgtaggtccggctgttatcggtatggttcgccgtgctattcctaacctgatcgcatttgatatttgtggcgttcagccgatgagcactccgactagccagatctttgcaatccgttctgtatacggtcctaacccgctggcggctcaggctaaagaagcattccatccgatgtatgcgcctgatgcgttccatagctctcttgctgctaaaggtgcaattgtcggttctccgaccgggactccgtttgctaaactggcaatcggtactcagattgaagcaggtgatattgtacaccacaccttcgcagaaactggcattgcatatctgcaaaacgttaccgcagaacaagtaaccccgaccaaagctggcagcgagtccgaagatgaagttgtcatgaagctgatggaagaaggtaaactggctgaaatcgctttcggtatggcgacttccattgccgaaattcaggaaggctttaacggttccagcaataacccgtgggctgaaatgtcaatgcgtattgacaaacaggttgttgaagcgaaatctcgccaactgaaagcccgttactctatcgaagttgcgcaggatctgcgtgctgtacacggtatggatgctgacgctgaactgaatgctatcctggctaacgaagttctgctggaaatcaaccgtgaaatcgttgacgtcatcaactttaccgctcaggttggtaagactggtatgactcagaccgttggttctaaagctggtgtatttgacctgcaagacccgatcgatactcgcggtgctcgttgggctggtgaatccttcaaatctctgatctaccagatcgacaaagaagctgctgaaatcgctcgtcagactggtcgcggtgctggtaactttgttatcgcttcccgtaacgttgtaaacattctggcttctgctgatcagggtatcagtcttgctatgcagggtgctgcaaaaggtctgaataccgacaccactaaagctgttttcgctggtgttctggctggtaagtacaaagtgttcatcgaccagtatgctcgtcaagactacttcaccgtaggttacaaaggcgacaacgaaatggatgctggtatctactatgctccgtatgttgctctgactccgctgcgtgcaactgacccgcagtctttccacccggttctgggcttcaagactcgctatggcatcggcattaacccgtttgcagacagcaaatcccaggcaccgtccgctcgcatcacctccggtatgttgagcaaagacagcgtaggtaaaaacgcatacttccgtcgtgtatgggttaaaggttgctaatataagccaattcctgaaaaactccggtcgggtgcaatacccgacttatcataaaccttatgacagtgtaaagtgttaattccaaagggaagactcgaaagggtcttccctttttgcgtattataacccggtataaataaggttgcaagcctatattctattgggagcgaaaatagatacacacaacaaagacaggaagatgcagaacatcggtgggtcgctagcctatttcgtagtaactgcatggcaaagggaccaatgaatgaaatgagcgttcatgctgatattgggtcggatagatttggtagatatacagatctggtgtatgacgaccttgttatgacattccagcgtgacgctagcggtaatttttggttttggtacgctgttccctgaattaacccaaaattctccataaggaggaatgcatgagtaagaaagaaaacagctatgttatgactcgtaaggaatacaacgaattgatgttagcattagcttatgcaattattcgttctgatcatgcaattaatctggtaaacaaagttaaccgtagcgttgataatgtttctaggaagaagtaagtttatttttggaatcctttggattcctttttctttttgtataaatatgatatatccattaaggcaaatacaggattcataaacatgactcatatttttactgaactgttgcgggaatctacttcctcagtagctaaccagacagcgcgaccgcaactattatcattaactcgcgcggtaaacaacctgattttctctgatctggtagcaatccagccaacggatcaaccagtatctgcattgtacggcctacgttatcttaatcatgatggtcagatgactttccgaactgctgcaacctatggtggcgcggttggtgatcgcacagagattgaagagttttcaaaagaaaaatcttatgaagaaggcgcactattcaaatcaggcgatgttgtatacgaagttgtgaccgctggtacagtcggtgaagatgccgcaactccagaagctgcgatctttaaaggcgtaatgacaaacaaaattcgtttctatagcgattgtgcatcggtagaatactttgaagataaaaacaccgaaattgcgtctacctctatgcagtttgacaagtggcaagttaatgtaggttctcgtaaactgaaaacctcgttcacgaccgaattgatgcaggatcttgaggcaagccaaatcaactctgaaaactctgtaattgatcttctggctactgttgcttccgaagagatcaacaaagatattattcagaagttgatcactgtatcatctcgctataaaattaaagggatcacccctgatggcgtactttctctcgttagcgttcaggatgcaccaacacaagcgcgtgaactttaccgctatgcttgcgaaatgagcaatcaaatgttgcggacttcctcctttgctggtacatacgttttggcgtcttctcgcgtggttggcctcctgcaatcttccggttggatggaagaaaccgacaatgctctaagcgaaggtcgtctacgttgcggtctggaagtgtacgcagacacgacaacacctttcgattatatgctcgttggttgtaagcacatgatcggtgatatggagagtgtaggttctctgttctactccccatatacagaagccgacggcgctggcgcgtataagagcgtaattgaccctaatagcttccagcatcatgtagctattatgaatcgttattcactctctgtcaacccatacacatcaaaagttgatcaggaagaacaccaggtcatcaagggtgacgattggggtaaaatggctggacgttcagaaatgtcctacattttaggaatcgaactgccaccacttgagattgacaacgcttaactaaatatctaaccaagacaagtcagatccgcccaagattttttcgacggcggatctattttcttgatgatataagttaaaacatggtatcccatgtctacgggcaacataaacagcaattctagttcctccagaaacaatcccattaacttctttcgcccaaaataacacacaatctacaggatcatcaagtgtctcacctaatacttgagcaacatttctagaaaacagattttgcatgtataacggtatagaacgaggattatcataaacgtgttctaattcatccatcgccagatttttttgttctaaagtttgccatgcaatcacatcatgaccgttatgtttgtggtcataaaacttccaatttggaatgaaaatttttctataatctggatcgtaatacttcatgaaagcattgtccataccgtaagcccctccagaatgcgctacaacgcgattttctgacaataccctcccaatggtactagccattatcaaaatgtcgctaggcgcttttctagagcctattaaagcacatctacgaagtggttttactccaaatagatcttgtaactggtcaaacataatatttcctccatagaaagcaatatcatactacaagttaataacaaatacaagtatccgcgtagcggaagcgagcacagcgagcaataaaaacacttccgtaattgattaataaatgttcgaaacaaatttttattattctataagataagtattcgttttgttcataatttaatcatacatgtaaaaactacacaaaaggatatcgcttcgcgaactcctacggagtataacatttgtgttacaatatgtagtgattaataattaaccaaagatacattttctatgttctaaagatctttcttcgttttgatcataatttaatcaaacagtattaatattgtgcacatgtaaactaaaattatgttaataacatatacaaaaaagccgccccgaaggacggctaatgttaattatttgttgataacgatctgatttcggcgaatggtaacattactcttagagatgatcagatcatccggcactacgttagttttgtatggttggaagcgaacaagcatctgattgcgtttagacccttccttaatcttgatttccatctgaatattgttgcctacgtgagcaaccgcaatttcacctttattctcatagacccacttgctggtaacgtctcccgcaaaagccttaataacttgcaatgcttcgtcgtatgcggtagagctgtgaactttcagaaggccagccgtagaaagacgggagcaggttatcgccggagattgccaaacatcaacattaatttgctcaatcagagtaacaccgccctgatcaactgctttgaatgcttcgaacattgcctttttcattgctacgtggtttttacggaatttcataattagtcacctctattgattagttattcagaatattaattacaaatcaggacattgccagtttgaatgcgtccattataacagtgttatttggcatgtcaacacgtttttgaactttatttttaaattttttgttgatgtggtgtttacgataaacaaccttttcacggttggcgtaagcctctcgtgcatcttttaccatcaaccatgccttagccgcatcttgtccgctgatcccgccaatctttttagcaatatcaacaaaattaagaccgtggtcttcgcgtagcatgtaaaccattaacgctgttttcttgtccatcacttcgccccattgacgattaacaggatagtgatcagcaccggaaactgaatcatgatagtgccaataaaccggataaacgcattttctgacttccacacatgacatgcgactagctgatagaccattgttgaaaccagaactaggatataaaccgaaagcggtgtaacttcgattagtcgggaaatctcattcatacttcacctcatacattcataaacacaacaacgaataatacagtaacagttatcaacgccattttcaaccccatattcataatattttcttcgcctcactatgacagtagcatgtcgatgcgtgccattataggcatctaaatcgctctgtcaagcacaaaaacaaaaaagccaccccgaaggatggctgatagatttcattaagcaggatgcgtttcacgaatgcgtagaactcgctctaacgtctctctgtccagcttatgtaactctttggactgatacatgaaaccattgcgagattccatgcaagtgcaatcactatatttttcttccgctgccgcgattgtctccagatctttggcgtacttgctggttgaataaacttctcggttacgccactctaacccagcctcattgaatttaacaatctcgtcaaatacccaccatccaatgtagataaatgaagttttgcgccacgggatcgggtgtacgtaacgaaacattttaacaacttccattgaacattttctacttgtacttgttgcaacttctactgtttcatcttcgatctgttgatatagtttagcaacacaccagaatttggctgtgtcatcgtaagtagcactctctttgaacagatgaccgtctggagtgatagaaaatccttccagtgcttcgccaacctcactaccgatcagagtcggtgacatttgcccttcgcgctgcaaataccagttatatttgatcgtcaaattaggcataccgctagaatcgcctacaatgttctctgacacaacataattaagtaagatctcattacctagtgccacggtctttgattccactacatcctgatctacgttcattgttgccagcatgattttagtcgatgcgctatcggctgaatcttccgactcaccccacacttttacagtatacacgccgtttttatctgctgtaaatttttggatcgtaatatcctgtgttgtgtctataacgtcttcgcccttactccaactataatgtagttcatagttgtctgctggagtcttcccaccagaaaattttactgttgcatgtaattctacgtctgtttgtgatgatacgtagaaatgctgcggttcggtgatatttacgattaattcagcttcttccatgaggaaaacttcagattctactgattccatcgtatcggtatcctgtaccgttactttatatctacccgcattttcacttgttgcacctactacagatagcgtagctgtgctattttcatgtggttggtcgtcttttgtccatgtatatgtcaaattgctgggtaatggttcgtcacccgctacagtcgccgttaaggtgaaaccatctccagcaagaaaacatcttttgtcagatttaattgatactgtgaaagtcatataaagccactcccatagaaaatccgaatttaattaattgaaatagttgattgccatcaaccagataaccattgcgagattccaatacatgagtattagaatagtgatgcaacgaggccgaaatagtatcgatctcgtctgggtatttgttctgtttgatgtaatacattgattttgttagacatgtagtatcctctttttaattgcataacggaactacaattaaaattataacaaatatttcacaacttttatcacccaaaaattacttgagtgtgtggaattggctgtgtttagtctctcgcaccttgacagacccatcgcgtttgatataatagatcagcgacttgagggtgtcgtgtacatacgcgtgcgggaaacgttctggatacttcttccaatctggagtattaacgatccagtcgaaaatccaccacgggcaggagtagtaaccacgaccgccaccgatcaagcaaatggtcggacggaagccagtaagatcgcaaaatgaatcagtgtcatgtgctggggaacgatgctctgcttcgttagagaaaatgttggctaccggagattccactttaacttccggtgcttcttcaacatctgacttaacttcttcgaccactggttcaactgccggagattcttcttttgtttcttcaatgacgatctcaggttctttcattgcttcaaccagagacggatcaacttcgtcgaataccactttatcatctgcggtgtctgctgccagaataagatcgttaatagtggttccttctgccggagtttcttcttccatttcggaagccagtttagttaattctgtttctacgaactcgatcatgttctctagcgagagcgtctttttgacctttatatcaaattgttttgcgtagtccgctaattctgttttagcggctttctgtgattctttgtcgtcggacgccgcaatagcgcggagttcttcgaaatattctttatcaaacatgttattctcctgattgggggtgtttgtataaatatttgtatactgtatttattgagtgaggctattcgctatgcaagatattaaaattcactttctgaactactcccatgttcaaattgaatgtagcgattcaattttattagaaatgcgagattattttagttttgaagtcgagggagcgcggtttcaaaaaagatttaagtatggtggatgggatgggcgtattcgtcttttagattacaacggaaagctgccaatcggcctaactaaaaccgtgggaatcttcgctaaaaatatgggctatagcgtatgggtagatcctcgcttattcgaaaaagaagaagttacagaagaagaaattacaaaatggtgtaatgacttagaattatattccggtgctaacaggatcaccccgcattggtatcaatcaaaggccgtctttgaaggtattcatcataaacgccgtatgttagttttgcctacgtccgctggtaaatctgcgattgcttgtatgttgtctcgttggtacttagagaactacgaagggaaagtgttgatcatcgttcctaccacgtcgctagtgctgcaaatgcgtgatgactttgttgattatcgccagtttccgtatgaagcaattcatactatcatgagcggtactagtaaacacgtaggtgatcgcctgatcgttgttagtacgtggcaatcagcatgtaaacagccgagtgaatggttccagcaatttgggatggttattgttgatgaatgtcacaaggccactgctaaaaacctgctaaacatcgttactgatatggatcattgccaatttaagatcggcatgactggttcccctcgtgacgggaaagctaacatgatgcagtatgtcgggcttttcggtgatatttctaagatcgtgagtattgaccgcctgatggaagaaggtcaagtgacgaaactgaaaatcaactgtcttttccttcgttataccgatgaggaatgtagcgcggttaaggggcgagaatatgcggaagagatcaagtatattacgtctaacccacgacgaaataagtttgcttgtaatttggcgctaaaactcgctaagaagggcgaaaacgtattcctgatgttccgcaatactaagcacggaaaacttatgtatgacgcgttacagaaggtacacgacaaggtttattatattgacggtggagttaagacagaagaacgtgatgaatttaagaaaatggcggagggtgacaccgggatcatttgtgttgcgtcttatggtgtgttctctactggtgtttcaattaagaatttgcaccatgttattttcggtcatccagtgaaggaatcaactatcgttcgtcagagtatcggtcgtgcattgcgcaaacatggttctaaggatattgcaacggtctgggatcttatagatcatctggcggtgaagacaaagagcaagaatgctaagaaacagtttagtcaccttaattatgctcttaaacacgcgcttttgaggatacagctttacaataccgataaatttgagtatgtcacgaaaaccatcgagatttaataaataggggctttaatgcccctttattctacggagattaaaaatgattagctttaaacgttttttggttgaggccgctattgacggtttcatgcgtaagatttattcttgtaatactatcgagggattaaatgaacttgaggcatattatgagaagcgcaagaaagaaacagaattgaaacctgctgatgatatttcgatccgtgatgccatcgctggacgccgtaagcaactggaagcggacaacgagccggaagaggagccggaagaggatttttaagatataaaaaagccccatcaatgatggggcaaaataaaccaattaaaatcggttatcaacaaattacattaacagcattgtttgctctacgagttgttcttgttcttcgccgttcgcatcttcactaatcgaacgttctgttactagctgtaagcagtagccagtgtgaacaacgccgttttctgtctggacggataacgcatcctcgacaggttgtttacaacaaatacagattttcataaaaattcctcctgcatgtatttagcgaccagattccagcatacgcaattctatagcattcttgatcgcaaagccacgagatttaacgatatcaagtgcgcgaccagcaaaatccattaccatctggtaatatgcaattttcgtatcaagcggtaagatctcgtcgtctgctgccatgacaactttcaattctgatttctcatattcagcacgacaccagtcatcactacggttagtgtaaaaatcaagacgatttttcatagcctttttctttttagcctcaagagcaatcgtctctcttttcgcctcgctgtaaatccttaaccactttgagtatactaccggattattcagcgcctcccattgcaacttagtcgcatcgatcttcatgtcagcttctaattgttctttcaaatcgtttaggtccataatatccccttattcacactaagacctatatcatatcacacacaaaatcactttgcaagtcttatgcgtagttgttcaagatcatctgggttatctattactgaaaagtagattgatactatgattgagttatcgtcgtactgcggagttacttctactgtcaggtttcggacccgtggttcatagtttcggatcgcctcattgatgttttttgataaggtatccaccgtcagtgggttcatgttctcaaacaaagatttattgagatcgcatccaaacagtggatcaaatggacgagatcccttgcgagtagtcacgatcagtagaatagaatccttaaccgctttaatccctatgttctttttaacgtcgttattccacgatctggatatattgagatccaaatcagtatacatctgattaatagttgccatgttatacctcaaagaattttaaggaaactggatagacctgataatgaatatacaccagattccccgcattcgcacttgatcggtactgccagcgtgatttgatttcttgttagctcgtcgatcacttcttccactttatccgtggtaagcatatccagcacgcggtcaaagtcctgtgcgttcaggtcgtctatattgaattgctgatcgccgatcacgatatattcgatacatgcaattaccatctgcataatatcaacatcttctgtaaacttaggttgacgaaacttgatttttacttgtcctaagtctagaatatatggttcaacttctggtatctgtgtgcgtgaaacatcaagagagtatactttctctttattgcatacaccacacacccaagtagcatcaattttcatcttattgaggctgtgacaccataagagaagaaaaatatattctgcttcgcatttctctagctctaatgcattgatccccgtacattcatgtatgatctctataacaacctctgacagcttgccagtctcttttgctgctaccagtttttgaaattcgccgaaggtgaaagcacgggcgtgtatcaacttttcgcctaattggatcttgaaaaagtattgcataataaaacaccctttataaacacatagaattatttagtattttataaatacccgaaagggggattataccatgaatattatccgaataaaactaccggaaggtgtgcagagatttaaaccattcacggtaaaagattatagagatttccttctggtgtcaactgaaattaagatgaatccagaagaagaacaaacgattcttgatgagctattagaagaaatatatccagacgtagatccggcatttcgtgaatatattttcctgaatgtctttactagttcaattggtaaaactaagataccgctttgttttacttgcccgacttgcaacaaagaaagaaaaatgttgcttaacttacaggttgaagcactaaaaccaatcgttctagaggccgcagggcttaaaataactttccggtatgttaaaccatcaaccgactatgcaaaaacgtttctggatgcgatagagcgtgtatctgatggtattaatgactatctatggactgaattgccggaagaagttagagaacaggttatcgattcaatctcattttctgaatttgaagaagttgttaagcagatgcacacaatcaagatcgaacaaaagatatcttgttgtgagagtcatgacctgaaatacataggtcttcttccattattcaaattgttgttgaatccagatgagttattcatcttttatcgaataaaccatctattggcaaaatcaaattattctatcagtgatcttatggacatgttacccgtcgagagaaacattgcactgacactggtcgagaaagacgtaaaagaggcaaacaatgcaaagaacggggtttcctaatgtctcaataaaactttatcaggattatgaggcatttctaaatcatcgctttatagaattgggtgctacctttgttacaatgactctgcgtgattcgattcgtggggtgaacgaaggattgttgcaattctatgataataaggcgatgcatacaaaattaaacgggagagagatcattcagatttcgctatccactgctaatacagatgaagtgtttaaccgaatctatgggatctctcatagtaatgtaacaattgaccaaaaatccgacaacattttaacattccagttaaagagctatcacgaatcattaaaccttaaattttctcgctcattgacaaataacgcggttaataacgtaactagcatgattgatgccatctataaggaagttcctttatggaaacctactataaagggtgataacgttgttattcctcgttgtccgtgggttagtaccataaatgactatatggattttgtgagggcatacgggcaaagcgtagaaaccgagtctttcgtgtattgctgggaagattttgatggtataacgatcgctggacacgatacaatattaaaaaatgagccaataccagctataatctgtgagcctagactcatggggcagtttattgatatgtcgcctaatctgatggtttttaatttcgagtggcagactaagagcaatgctaaagttaaaaattcatttagcaatgtgacatacacaactattgattttgttactaagcagtataataaaattattgttggtaatggggataacattgcacactttgctcatggtggcgcttatggcgatttaacttataagaatgcgtttttggaaggttctaaacttgccacaatagaacaatatgattcatatgctaccgccgtgtgtcacggtaatttttcgttgcgccccggtatggttattcgattctttgatgagaagcaacaagcacgcaatgattttattgttgacgaagtggtgcatgaaattagccgagagcaatcattaactcacctgtatatgatcggtaacagcgaagaattacaggaagtcaaatttgaaggtaagatataatgacagaaactaaacctatgttaaaatttgttgttcctgtaaaaaaattagagataaacgggaaacatatcaagattccaaaaatggggattaagcaacatcgattattaaaagatgttcgtagctgtgatgaaacattaaagattcttcttgattcaatctgtcctgggttaaacgctgccgagtctgaattggttatgcttaacctttgtgcgtttaatggtaagtgtctggaagaaaaagatggtcttaagctgtctgatgtgtatatttgtacagagactgaatttactttaaatggtaaagtctttaaatttaaaaatccaatgtatacttctgaccccattatcgatgacgctgatttcttgagtcatcattatcacgatcctagcgtagacttccatgatttcccagcttttattatggattgggctacaggattaagaaaaactattgcactggatacaccggaaggtactatctatggtggaattaacatattggatcgcctatcatgaatgacgcattaacatcatttcgcgggatgcgcaaggaagcggaagaaaacccgattgataaacttaacaaattagataaacttgattctattgataatttgcaagccgctaccgaattggtggctgagacagtggaacaaaaatctaatgaagttgttggtgcggtagaggataacaccgcagccaatgaattgacggcagaaaatacacaatctaccgctggcaatacccaaaaaacttatgaagaattgcaaaaactcaataatttctcttctcagatgaatgagaaattacgtggttttggtgttatgatggaacgtagatttggtgttgtcagtaaaatggctagcggtattggtgcgattgaagaagcactgaaaaaaccggaacaaccgcaaacaatgccatcacctcagccagttttgcctactgtaccggaacagcctaataatgacaactatcaaggtcttccaaagaaaaaaccagatgttgaggaacggaagaaaaagaacgccgcagataagcgcaatgcggattctatggaaaatcttcttaaagttgttcgtggaggatttaaagaaaccataggtatctctaataaggtcttagggatgttatttaagatcaccttgaccgctatggcagaagccgcaaaatggggcgctattttgatgggtattgtttttgccattgatacccttatgattcatttcagatattggagtgatttattcgaaacaaaatttgatgaatttatggataaggccggagaatgggctggaccaattagcgatatcttaaccacgattcgtcaagttcgagattattggtctaaaggcgaatatggagaattaattaaatctcttgttatgggtattggtgatgcattctataaaacctttatccaacttgatcgaattatcactactggtattgctaaaattcttcgcatgatccccggtatgggtgattatgccgataagttagaatacggtgctttaaagtctgctgttgctaaaggctataagccaaatgaaagagaactcgaattaatggataaggtcgagtctgaacacgaagaagacaaatatggagagcgcacaggatggacaggaaaagcccgtgatattggcgaagctattggtgattctattaaggataaagttaacgaaggtcttgttagtctgggctggagagatcaaaaggatgttgacgcagagaaacgacaagaagaattaaaacgcggggaatacaagtctgtttctgctgaacaacgatctgctagtcgtaaacttaaaattaaaagcgagggagcgatcaataatattaatgaagttatggagaatttgagcggtgactatgacaaagaaagaatggaagagttgaaaaaggatattgatgtttaccgtgagcaagttcaagatcctacattagttgaaagtgatcgttctcagttagagcgtcttattgaaaaatttgatgagatgtatgctgataaaactaagggtgtggttccaaccaaacctgttcctgcaactgaaacggaaacagcaaaacaagcggaacgtactgaacaaatgcagaaacaagctgcaatccagcaacaaacgacaaatcagacctcaaacgtaaataatacacaaattgtaacaaacaatagaactattaaacagggtgcaccaacaactagaattgatgcccctggtacaattaatatggggaacttttaatgaaaattagtgttatcaatgatgccgttgatagctttaaagcgggggttaaaacctccgctggttttacctcaaaaaataaagggaaaacattaaccgctcaattccccgctgaacgtgctagcggtaatgatgctagcggttattatatcaacgacttatataataatggtctgttattcactgcatacgattatacatctcgtactaccggatcgttgcgtgatttcaggaaaaagaaaaatgttgctagcggttttggcggtagcgttaatatcgctggttttgatttaaatttgggtgggagaaatgctgcatttgaccgagaggcaattgctaatattcttcttcctcgtagtcaatctgacgttgacgctgctagccataagtttaatgatgttggtgaatctgttatttctcgcggtggtggtactttaggcggtgctctttctaatatggcatctactgccgtttttggtggtatcgaaagtattactggtggataccttgccgatcacggtgaacagatttataatactgcgcgaagcatgtatgctggtgctgacgcacgaactaaaaactacgtatggcatctaaccccacgtagtattgaagaccttcgcaatattctaatcatatacgaaacgtttttagagttgtcttatgggtctagtggtatttccagcaccgcaaaagaattaaaagcggaagttgatgcgtggtataaaaatacactattgagaaaatccaccccagaggaagcgaagagaaatgatactctgtttgaaggtatcaccgattttctatcaaacgcaattactgtatctaacccgacaatatggatgatctctaacttcggcaagcgtacatcgtttgaagggcgtagcgatgcatttggtcccgctcagatctcaagtgtacgtctggacaagtcgcctgatggtaagtttaatggccttgctatttctcctaacttgccgagtacctttgttctggaagtatcatttagagagatcttgacactttcccgtggtactatatttgggagtgcggcataatgtttgatttaaatgactttaacgaacaagccgctaaccttgactttcagcgatctaacttattcagcgtggcatttgccaccactccaagtaataagacacaagcgatcctagaaagtatgggcggtgcggtatatgatattataccaaatgcattaaatgactatttcgggattactcgtggtgattatactgacgcattaacaaatcttgctgtgcagggtgttaggcgtgctgttgattcatctggtgtcaaaaagtatcttttaggtgcaatgtcatcccgcgtagttcaatctcttctggggcaatttgatgttggtacatatgcgcttgactggttcaatatggcatataagacaagcggtcttctggtatatgctgttaaggttccagaaaacagattgaattatgaaatggaccgtaaccacaatgcgccaaacattcgaattaccggacgtgattttgatccgcttgtattgagctttagaatggactctagcgcatcaaactatagagcaatgcaggattgggttaactcagtagaagacccagttacagggcttcgtgcgcttcctgttgacgttgaagcagatattcaggttaacttacataaccgaatgggagttcctcacacgatcatgatgtttaatggttgtgttcctgttggtgtgagtgcaccggaattaacctatgaaaacaacaacgaaattacaacattcgatgttacttttgcgtataggactatgcaaactggtgctgtaggagagcaagccgcgcgagaatggattgaggataaggcaataaacgcaataacaaacactttcggcaataatttacttgatagtgggttatctgctgctggtaatgctttatcgcgtctaaatggcgttggtgggcgtgtggtgaatactgtcactaactggttctgataagcgaaaggcggggattatcccccgcctttttattttgctaaatcattgcaatattttagtgccttagtttgaaattctgcgctgttaagttcttcataacggtcataatcaccgtttaatgctgcctttcttgcttcttgctctatctgcatgtcagacatgataatacagcgatcccgtgctttcatcttctcaagttgtatagactcttctttctgcttgcgcaattcttcttgacgcttcttttcttcttgtgctttctcttcccgcgcttctttgattgcatccttgaacatctgcgtttgtggtgctaaaccaactttaacgcgatccacgtctcgacgttccattttagaaataaagcacgattcgatctgatcatcacttgcatatgctgctttacattcacgaagcaagaaaaccggatctgatttagcattcatcatagcttccatgttggcacaaccagtaagcatgaatgcagccgcaagaccaatcagtttaatcattttcatttagtcacctcaccgaaaattgtaaattgtctacgattctcatcgccgaaagattctactacgtcgtttaccttgacgcaagtcccgcgcggtaaaattacttcacattcgcaagggttccatgcaattgacccaacaacaaaacctttatgatcttttacgtcaattacccatgatacattacaagaatgctgcatctttccggtcattgattcatatcgattctcacaataaaggctagtgctgtttgatagccatcctccaaagatgattggtgtcatgctggtcgatacaaagtttttaaaggtaaactccttatcttcaatgatgcgctctattgtctgaatgtcaagatgttgaccgcgataaagagtaccgtttaacttttcggttttatccatgacacaatccatcaaatcaacaatctctgatatctcatcggtcatgtcttcttcccctaagagagcaccatttacccattcgtattgctcagacacataatcacagattgcattatattctgctggtgttatgttgttatgtttgtaatgtttgaatacattatctccaaagtcttcggagtgtacttcatacatcacattaatgattttcttgacaaatccataatcttgtgtctcacgctcaaggaagcggataaccttcacataatcatcaaagttaatctgatcgctgatcatctcagtgatcatgtagccattaatcccctcaatgtcatatgtttcgatgtaattatccatacgttccatcattgattcgcgtgattcttccgaaagacgaaaatcctgtaatttcttgaacattttaaacctcccatataacagaaaacggggctagtataaaactagtccccgtttgagtcaaccattatttcttaaaaattacattttaaatttatctggcattgcgtctacagataccagatcagcgataagctgacgtagagttgccttatctgctttcttacgttcggttttagcttcgctaatgaagctggagaaagacaggtcagaagcaggtttaacaacaccttcacggatgaatgcatcaccgtccgcgatcatctcgccagattcttgtaatgctgccagttcatttttgttcataatatgtgcctcaatgtaataagtttcttgtgaatccgtcgatgccgtagcacgagttaccgtatcaaaggataacacaacaccgcgaggaagtaaaatctcgcattctttgtaagcaaatgctttgttacctactggcaagacagggatgttttccgcgccagcaatggagaaagcaacattagcgccaccttcaccacgagagccagccatagaatcaacaccagcaacggcactagccacgtttgcattccagccgccaaaaatgttaggtgcaagggaagtgctcacatagtttttaaagtaaaacgctttttgcttacgtgcagtttcccacatttgcgaccggaagtccataccacgatacagaatagtacccggatcaagtttaacgccatagttggagaaggcattatccagtgcatcgcacatcttgaccaattcttctggatctgagatgccttcaaactcttccagcttacggtcggttaggaagttgttcatattgatgtatgctgcatcggcatattcgctcaacacaaaaccttccgcgcctggcagatcaagatcaatatctgccatcatttcacccatgttgctagcaattgcttcaaacataccggaagcaacattacgtagggcatcggttttaatctgggtgatatgactacgcagcatttcagcttttacatctgctggcatagactggtctactcgatccattgccagggcggtgatcttgttttcgaatacttcctcgctcatgatttcttttaagcgtttgaccgaggctgcgataacttccgcagacaacggatcatattgatcctgaacttttaccagttcgcttactgcgtattttgcatcggcttcgctttcaaaaatagtacgcatgaaaccatagcgagtgataatatcacttgtccagtcattcagagaacgggcggttgaacgttctaaggcttgacgatcaatcagagtattaaactgtttcttaggttcggcttcggtgatatcttcttccggtttaagattaattttttctggatgattcacatagtcgctgttataggtcgcttgagttttcagcatttcttctttagtcaaacgagatttagccgctacgcgttgttccgcttccgcgtttcgttcttcttctgacacaagactagccgcatacgcctcatctttagtcagagattcaccagtagccttagatacccagcgatcacctaaatcactttctactttagtgaacaaggaatcatcaagtttaatccctttaatcttatcaatcgccataccgcgacgcttgacaacaactaaagcgatctttttgctggtcattacttcctgctggaatacttcaaacttcggtgtacgacgcaccaaacgctctataacgcgcttaaccagttcggtcttacctttcatgcgggatacgttaaaacggaacataacagcgtctaattgcgctttacgggctgtttccataaccacatcaaaagcacttgacataactgcaatcgggttatcgcctagaccatttttaagctgtacaatacgaccgcttttgttcatttcgcacagtacaacatgtgcggtcttgtcacccatacgaatgattttaggtgttttgttggtgaagttacaaagacggacaatcacatctttatcgcgtgtctgtactgcaaaaagctgtttaggattctgcttaggctttaagcactgtaccggagcaatactgccaaagttttcttcctcttctgtcaacagccatttctcgaaagattcaatcattagatcgtcgatttctaagttaaacattttatatcctctagttgataacctataaacctatatttatgaaaacggggcttaacgcccctttttattataatgcaccatcaagcaattgctctaatgtgtatcctgaatagtctttttcaatcaggatatattttcctactcgtttaatacaaccgcgcatttcaacgtattctgcgtagttgatggtgcgagttgttccatcttctagcaaagcagtaccgatttcgttaatgcggtcataagttacgtcggtaatgatgatttcgatgttagccatttgatactccttagtagttcgtttcggtatgtgtgcattataggggatcaccgatccccctgtcaacaacttttttagttattttttaattgctcatcttgcaatagggcaatcacatgctggcgatgttcttccgattgaggcacaccgaaaaagtttgttttgtagaaatactctaatcggtcttctcgtgtgctctcttccatcatgatcgcgggtagtccgagatttcggaaacgtcgcttttctgctggcgtaaaatcactgtaatacaacatagaatcatcattaccagcaatgctaaactcatctttcataaaggagaatattgcgtttaaacgctgtttaccgtccacgatttcgatctcatagcgagagccatcatcaatcttagccattgcgatagcaccaaccggaaaatcattaatcaggttttcgataaacatacgtttgttttcggtgtcccatactaaaggacgctgataatctgggttcatgttgatatagccatcttctaaccatgcatcataaacagagatgacaaagtttttagtattggtatagtaacggcgtttaggtgttaaacggttcatgttatagtctcctgaatggatcatcacgtaaatcaatatcttttaagaactcatcccatgaatggcggatattgttcttaattctccagataagagcagggattgaacgctctcccatctggaagtatggatcatatgatccgtatgcccaatatgctactacaattccacaatcagcgcaacagtattctatttcacttgctggcgaccaaagtccatcaatatgatcggtgatcttgctttcgatgttatggctatgacaatcagggcaacggatgcaatgaccttgtttatcgtaatttgacgttagcgaatacttaaacaatctcattatagatccttatttgcttcaaatactgcctttgcgaatcctcgcggggtaagtgaccttatagtctttgttttcgttcctttcccgcctagcttagaatgctgtttactgtaccctttattaatctgcaacggtttcttttctggcattataaagccttgtccggtccataagcaagtcttttttgggtacatatcacgggcggaaatatactcaggaaacgtaggatgcttatcatcttccggcaaataaccgccatattcccacggatggaacatataatcaggcttacgccacatgctagagataacgcttacaggattctctatcatgtagggaactcctagccattcacccaaataagcggttattttagctgcccttacatcatgaacttgaattaatggtccttgttctcgtttctttcgttcaaagtgtgcagcgccactaacagctaaattggtgcacggtgggaatgcaaagataatatccggtttcccccattcaaggtccattgctctttccagccaatccaaatcaatccatgtgtttacataggtaatgtttggatgttcaaatcgggtattatattttttgtatgtaccgtggtcggcgtcatccgcattaaagcagactaccttatgacctgctttagcccattctagccccattatccccgatccgtcaaagttgcagaatattaatttttgtttcatatacgcccctttaatccaacacagattttagaaggttctttgccgtgccacattaagtaaagtccgttaatgcggccttgttttgtatatgattcttttctgatcttcttatagtgtcgtgcttcctcagccgattgtttagaataccaatcataaaggaagatgaacaaaggccacccattagcggccttaatgcagttattcaaaaattccttattgcgtttaattaattttcttttcacgctgcccccattggtttgatagtaacagaatctaaaagacctttgttagccagttcgcggcaagttttcagatccgaaacttcccagccagccgcaatcaggttatcaatcaggctgttagcaacttcttcgctcatgaaagagcactgtttgccgatggtgtagcgtacacgctgtaatttcagtttacggaagcctttaacgttcaggtctttagcgattttctttgcggtttcgatgttagccattgtttgattctcctaagtggtatctcgtcttgatggttgtattgtaggggagttatcctcccctgtcaacactttttataaaattatttgttaatttctggtgcgttgctaggatagtaaccttctttaacacccaggtatttcgcaaccatccctacaatcttctgtgctactacaatgtcaaatttcagataatcttcgccgtgggtttcaatgatatatgcttcacatgctgctttagtctcgaacattttgattctcctatttcgtttcggtatgtgtgtagtataggggatctcccgatccccgtcaacaacttttttaaaattattcgtgattagtttcgatgttgtgcattttgcaccagttcagccaatcgcccagatcctgatagttgatgcttttatctgctgtcatcgtttttgtcttgatacccatatgtgcgttatgagtaagcatttttacagtgaactcaattttatcgcctttagctttaacatcaaccagtttggtccactggctaccagcgccgcgaatgttcataccaacgatgtttccgatgtatgcttctttgtttttcaggatttcggttgctttgatgaatttcatttttgattctccagttcgtttcggtatgggtgtattatgctatgttcttactttggtgtcaacaacttttttagatattttcagaaataaattttaaaacttgacgtaaatgtttctcatctttgatagtcgccggaagttcttcttttacttcctgtgcaagatagatatttccgttccaagtgaaagatccgtcttcgtttacgcgatagctgaacatccactcgcaatcattttcgatttcatatacacacagaagggtgtgatcgttaaagctattgatttcaaggtcgaagccgtgacgttttgcaaagttggtagtggttttagtcagtgccattgtttgattctcctaagtggtatctcgtcttgatgggtgtattatgctatagtcgtgacctggtgtcaatgcctttttaaaaaaagccgacactaaggtcggcacattttaaaaattcttgctatatatgcaagcctcataatctagaggatgaccgccaatcctacccggcttaatattccaaccgcatcgatatttgctgaccatgctaacagtttcggttcttagagcatttctttgcaaatcataccccctaaattcttgtctataaggacagtccgctttgcaagttggcggttctacgtcatttagctggtcggaagcagttggctttattatcaattctttgtttgcaataatcataagcacatcccattgaagacaatttaacatcttcgcaataagtgttgaatccgtcaaacacggtcacttcgtatttgactccatcagcgatagcttttactttataccatccatgcttgtataaaatcttcatctttatttcctcaatctcgtttcgatgggtgtattatgctataggctagaccaggtcgtcaacaacttttttaattttttggaaataaaaaaagccgacactaaggtcggctaataaaaatcatttagacaagtaatcattctgtgcaatacggtcggcgtatgctggtgttatgtcaatcgccagcactttaacgcgtgctttcttgcgacctgggttttctcgtaaccagtgctcatgaccgtgaacatttttatactttgatgcttcttcaaatgtacggatcggacctgggtaatcagcgtaaaggatctctaggtcttcggtgatgtaaaaatatacatcgtaattactgttctctagtttaagcagagagttgcgaaattgtggtaaattctcgcgggtaaattcaactacaagatttttcatagtgatatcctcattcagatagattaaaaggggcttaacgcccccatatattaaaacagtccttcctgtacaccgtagtagagttcatcgctgataatttcattaatgcgacggtgtgcatattcctgatttgcgaagttgtcagcaagttctactttagtttctccgtcatgagtccatttagtgataactttaccatctgcaaatttgaagttgaactctttagctaccgcatcgcgtaccagacgtgcaaacttgttgttgcggattgcattatcggtttcgtgtgcagcgtgagcgaatttgttaactttcagagtgatagtaatgtatgccataatttgattctcctagttagaaagtgtatctcgtttcgatgggtgtattatgctatacacccgatcttatgtcaacactttttataaaataattttttgatatttttctatgatgttcgtgtaagtcacatcaaccgctagcaccgttgcttcgaatccaccgtttagccaatggctatggtcatgatcgtgaaagaaaccaagaccagtacgaagaccttctttatattcggcgcgtacatttagatcatcatcgataaacagataaaaccatgaatttttactaggattgatgatacaacctttcagattagggagaatatcacgactaagaataaacttatcacctactttgaacataatattagtcctcacttataaggtcaaaccaattgtttttcgcataatgcttaatgcgtgcttgatctgcttccgatggtgatagattccatgcaaccactacaacttctgacgcatcgtcatccgtttctgatacccaatgattgtgattcatacagttatttgctatcgagtgagcaaatgatttcatcactggagacgtataatcataataacggattttcagattttcatcaacatacaagtagatcgtataaggtttatattcagtaaccagtaacagacagttacgcaattctgggaaaatctttttagttaatttcatattctagttctccgtaatacacagtaatccatttttcttcatactttgtatctttccagcacacaaccccgtttactgtgcaatctttggaattgacgaatgattcatattgttctgcatcttccatcattgcatgagcggtcttttcatcgaatatatcgcagatcgctttatatgctcgataatctttaaatttgctcataattaacaccactcaagagtttttgaaaacacatctatccattgttgagtatatgcggtttctttccatgacacaataccagtcgaataatggtttttgtttccagaaaaggacgggcattttgatgcatcttccatcatcttttcggcgaactctggtgcgtatactcgcaaaatctgttgatatgctttgtattctttaaatttgctcataatcattcactaccttatcagcttcttttgttgtttttacatcaactgcgataactcgtaaaggttcgtcatggttccaccagtggtcatgaatatcagcttgtgatttatcaccaaaggaatcacgaatatcatttttacatttatagctaatgtgaccttcatagtcaacataaaggtaattatcgaaaatcggcgtttttaagatcataccgaaaaatctttctttgtgtgtcttatccagcgttgcagtaattcgcatcataatatattcctcttagaaagggatggtcatttcttgagcttgtacgttctcgttaggattaaacttcatccagccgatattgtctaccagcatatgcacatttttatcatatcctacgtgagtagtcaacactaaatgtgctttaccttcaatgatgagttccatgtacttctgaacttcgatagctttcattttgattctccgtttgttgtcttgatgggagtatcttactactccctttaatcattgtcaactattatttgttaatttctggtgcgttgctcggatagtaaccttctttaacacctagatattttgcaaccattccggtgatcttctgtgctactacgatatcgaatttcaggtagtcttcaccgtggtttgctacaatgtatgcttcgcattctgctttagtctggaacatttttgattctcctatatctcgttggtatgtgtgcattataggggatcaccgatcccctgtcaacaactttttgaattatttttcttgatgctcgcgatcgtacttttcgaaataaaattctactggctggtcgtggattgacagcaagccaaagcgtttagccgctcgcaatcccatattgcgctgaatgtacttctggaagttctcgcgtatacacttacgccaggattctaagcccatgcagcttttataaagattgcattgcacacatgccggattcatgttatcaagtatatcatgctccggtttatgcattcctacaaccttatacttccacgatccatcatcattacgggcaattcgtccattttcatcatagacaacctttgagcgtcgtaatactggtttgatatggtctgcgtgccagcgatcccctagttcctcgccacaataggcacaacgtccaccgtatttcattttcaggatctgacgttgctctttctttgacaattttttaggtttaggggctttcgccccttcattatcacacatcgaatacctcttttactgtatttgcagcggtcttgtcgtagcgaatacgtttgatgattgggagaaataaagagaactccggttcatcttctttacgtgatttgctgcggatatacccgttgcatgtcatctcaataacttttccaatcaggttatgacggtcagcccataacatttctcggtcgagttcatttcgacgatcgaacggaattacacgttcagtaccatcatcacctttttcggttgtagtgtcggttaatcccgatccggtgttagtcatcattcgtccgcacgcactacggacagtaaaaccgcctaccttattggggtctttactatgcggatatacatcaacaatttccgcgtcgaagtcaatcacttctttaaatttaacctgatctttactacggcgatcttcaaatacaccatgtaaatttttaaggataataccttctaagcccatgttgacataacgatgatatacttcgcgagcttcatcgatattgttaactacagtgttttcgatgatctgaacacgaggatcgttaagttcttcaacaatctgttttagttcttcgaatcgatctttatattgcttcgttgctttctcgtttccgtaatacacatcacggtcgataacatcccagacagtgtaaacaatacattgggcttcttcttttggaatagttcctttaagtgatttgttgaggataccatttccggtctgacgatctgcaacaacggattctttcactgcttccgctactggcgttaatggcatttcctcttcttcaaatatccatgacagagtaccatcataaacgctttcaacgaagttctgcgctggtgtttgcgaaagggtaggcatatataccaattcgccatctagaacaattccacggcctcgtagacgctctaaaaccgcaaacaaatcatcaagcccttgataggtattacctgagcgggtatagattgctaatgtttccccgtcaatatcagccataccacgagcgccatcgcttttaagttgtgcatacgccggatacttgatattagcaatagtcttatcagaacatgacgatgcaaggtggcacggctgctgggggatcagtttcttccataccttgtttgcagtagtagcggaacaaccacattccagatcacgattcaggaccatcattgcaactttagcatcatcctctgacaagcaagtcagagtatcggtaactagctgtaatgctgcattaccagttacttgacgcgtggcaagtttatttttaaagacctgtaatgcaccggataaagacaatacagacgaatagcgagacggtttatcgtatttctttacgccaaacgtaacctgtttgcaatatgccagataaaagcattctttcagcgtttcattgctcgcggattctttcagaatcttttctttcagcgatgttttgtctgttgctgcaagctgattaatgatattaagaattgacattttcacctcgttttgttaaacgttcacgaatatcattgaggatactacaaaattccgattcagtcaatatagtctttaacggatcagttccacctatgctatgacgtaatttcttatttccggtagcaagtaatgctttacaaaattctgggttattccgtgccatcgtaacaaatgccagatgtaccagtctgtaataatgctcactcattcgatgaatcgggcgaccctgaaaatataacatgtgattctcaatcttttcagttcttccggttctttttgctttgccaccgtgcatcaaaaagatttctctttgtctctgagggttcttaaatcttagcccctgtaaaaatccttctgtgctgttaatatcgcagccaaataaacggaatggtcttttattgaaattactcaattcacccgatggataaggtccacccgcatagatatcaatttcagaagtcattgaaactaatctcgctaatcagagagaacggatcataatcgtcattaggaatatcgatagtaatcgaatgcgggtttacccatacaccaaactggtcttcttcggtgaatacttcggtatggatttcgtggatgtttacattcatagttttcataataaaatttccttaataatcaataacttacaaaatcatatagccaaaatataggcgggattatttcccgccgtttaaaatcattaaccgtaaactaccacaatattctgtttgtgcgttacagtccatttcaggtcgatctcttcttccttcttaacgccgttaataacgtctggatgaggaactttattcatcttgccatgtggcagtaaaacagttttacccagcaattctttatctaccgtttcaccgatatcaataatcttacctaccagcggaatctcgcccatagtgcgcttttgctcaataatgatccccatagagctttttacttcggtccctgcgctttctgctttagcttcgataattacataatcaccaagtgctttaggagtcttaacggtcataattttattacctcttcaaatcaatacagtttaatgatgaattatttataaatttcgatgatctgcgctggagtcagtccgtctacatgaatcagactatcaagcccgaagctacgaaaaccttcaactgcaatttcatatactggcaaagatgtttctgattctttacgcggtttttcaacattaggaactaaccacttttcgtatgtttcgaaaggcatcagtgccggatctcgcgtggcgatcatctcacggacagtaccatctttcttagtaaactgcaaagagtgagtaccgaccgaaaacattttctttagtgcttcacgaagtgcgatattatcaacttgttcagtcattatcaatacccttcaaatcagtcaataatgcttttggaatacgcgtgattgtaatatctgcattattcagaatatcagcccaatcacgcccaccatttcgatcatatgtgtcgcaatagtatagatgtttaataccactgtttgcaattgctttagcgcaatctggacacggtgaagcagtacaccacatactagcgccttcaatcgatacaccgctacgggcagcaaacaaaatagcatttaattcagcatggatctcgtttttctgtgaccatgcactatgctctggtcgtttttctgggatcattttgccgtcatcatccagccaaccgtttttatgtgcatgacagctacaatttacttgccctgctggagttccgttaaatccagtagaaatgattcgcccgtctttttcgatcagtgcgcctaccttccacgaaacgcatttagagttctttgcgattagataggcgatctgcatgtaagtttgtgacaacataatataatcctcacatagtaattaaccgtatacgcgaaagtattctactgatccgtcgctatactgttttacattgaatgtattcacaccatgattatttctcatgatgacatatacactgcgacgttcatcgctaaacggcataactggcgctggttcaatatcaacactaaaaccacgtttagcaagtgcttcgcctaattgcttgagtttatcggtaaacattaaaattctccgtagttaacctgaaaacattctacaccaattgagcggtacatgtcaaccacttgatcacggtcatctaccgccaaaacaacatgataacgcggtgcaatttcagagaagaaaatctctttcttcacttcatgatcaggacgacgatcattagtttcacgttgaaagtgatcactcggttcaataccctgttcacgcaaccattgcagagtatcttcttcgcaaacatcctcacgccctgagcatgtaatgatacgataaccattatcacgatacagtttaagcatttcgatcacttgcggacgtggtttatcttctttgacctttgtccagtcaaacggatgacgaccgcccttatccgctaatgtcccatcaatatcaaagatcactgcctttggcagcatggtattcggtttgtatacttcttgacccatatattcctgcatcagataaaattggttgcgcaaatgagaaagtgtaattgctttctcaccgcgatagaaattacgtttctttagtgtctcaaatgattcattgaacacttgttcagtatacaccgcgttaaattcttttgcaagttctttgtagaatacacgatgtttttctttcaggttggtatcggagataatgatactcaatccgcgtgatagagtctcacgagcaatcattctctgaatagactctaccagcttttctttttccttagtatacttgtatttcaaatgtgagtcaacaccaaacaacataagacgaagatcatcacgattcacattacgataattactaaaccgtttacatgtttccatcgcccatgtagttttaccggacccagaacaaccaacggttaaaatcacttcacatttcggcattatttctccttcggtttgcaccgttcctcattaagttcttttcgataataacacatgatcaacttactttcaagtgtatatctcttaatatccgcaagccagactctgaatttttgggagtcctcccacgacatagaaactctaggtttaccgtctattgtatccactttcaggtcaatgtcaactttttctattggtgctggtagtggaggatgtaatttcggttcctgtgaataatggtccattgtacacgaagaaagcgcaaatacaataggcaaagcgaagacatggattatggaggtctgaaaattcttatgtgctttcttaaacatccagtgtatcacgaaaattgaaaacaccatcaggataataatgcttgcacctatccacagataatcaaccagattaaaattgcttatctgctcttgtgtaggcaatatttctatgctcatttagtagcctcctttaattcttcggtaaactccttaaatgagtcattaagctgtttctctaccaacttgggtttttgtgctactacatagcctcgtgtagcgtctttcattgctttgttttgttcttccgcaaacttagttcttattccatacatctccttttgtagtgagtctacgaccttcatcttttcatcggtctttttcttatactctgtaaattcctgattcagtcgatctacctcctttttattttcccaccacatattaccacctacccctagcaacacagagatgataacaatgtatatcagctttgacatattacccccaacgacaaaaggcggggaactagccccgcttattattaccaatcaatcttatcagccggaataagtttcttataattccgtagatagtaagttttcattgaatccagaatacggtcataatcaagaccatcaaatgcaatcatcagacacatgaaaatatatgcttgtgcatcaccatgtttacgtgattcgatagtcgcatttgatgcatatgtctttctgtcttctcccgcgtgtgcgttataaaattctgttgctgtcgtgaaggcattgcgaagaatagacctgaatgcttcctcgaatagctcgattcgttccagtgcttccggttcgccttcatatgcagcacgcaaatcatcggtttcgctttctacgacatagtagatcaggttattaggaaacatcgatgtgtttttaatgttatgcacaccaatataccattcactcttcactttgaacatttgaccgtctttagtgcgtgcaacaattccttcgataccttctgcggtccgaacttcatcaagaatattgctaaaacgcgctgaatcaacctgtaacgcatttaccagatgaggacgtaggattgcgtcagaaaatagcatttgatgcggtacgtactctcctgtgacgttatggcgtacattcagaagtgttagcgacggttcagaatattctacaacaattcggttgctgggcgctgtatattcaaagttgaaagtataatcagacccaatatcagcaatcttagcgcgtagatccgcatacttctctgaatacagaagaccgtttgctctctctgcctggcttgagtacaaggccgctttagacttcaactgaacatagccgttatcaatgtaggtgcttactagactaccgtccattttgtccatgaccatttccacatcttccggcttaaagcgagcgcgatcattctcacccaaattaaaaaacttctccataggacgagatgcaatgcggaccggacgacctttatcgtcaatttcaaacatgatcccgcgacactctaacgcatctggtttattccacatttccggtttgctcaagtacagataactaaaaatgcgcatacgggtttgcatcgccgtaatttcatctttgtaatagaacgtatcagatccgtcacatagtgccatcagatttttgaacaatgctaaaacttttttgttgttttcttttgttgacataatttgtgttccattctggtttaaatttggtgatcaaaacaggttcttcgatatcggcagtgcttataatatccttacccgttggattctcgatgtacaactcaaagcactgtcggtaatagaatgttactgtcttaccttcctctagcgccttatgaatattcttactcttgcgagtatccgctgttggtgtttgtctgttaatgctagtccggtaataattgatccgctttctgagattgacagtctgaccaatgtataccagttcatcatcaacaacaatagcgtaaagaacatttaaacggttcttctgaggcggcagaatcacatcaccatctttacactctaaacatgaatatttaacgaatccatagttttctattagctcattaatcattatcctttcctcacgtcacaacaaaggcgggatttctcccgcccaccttattaactttccagaatatcgcgagcttcgttacgctccttgatgattttcaggacaaattccagtttttctttgttcagcgttccattttccattgcttctttgacggtaaacactccgccaccttgcccgtatacagtgacagtgatttcacctaacatcgtggtatgaaaaccgccaattttcggtgattcgaaagaaacaattacctcgcgaacagtattaccgtcgttgatttctgagagggtaatgtcgtttttgtaggcggttgctttaaccatacggatcagcatagtctgatctggggagatggtcattttgtccattgcatgttgcaatgcagcgtaaccgaaaactttaacgaagtccagaacgtctttgcgagtttgaaatttaatcatcttgatactccttagttgttttggtatgggagtatcttactactcccgtgatatgctgtcaactgcttttttatgcaaccgcaaacatcaacatttgaacattcttggctgtctggctttcaaagttctgacattctttgataatgtcctctactttctcgccggagatctccgcgtaagtttcgattgccattttcagtaccgcgtcaaagttgttcatttgattctccttaaagtgtatttcgtttcgatggggggtatattactacccccgtttcatgctgtcaactactttttaatgacaagttcgaattttgctaccttgcgtcctcgtttattgaaagcaacccacggacggttttcaatgtagaacaattcttcaccaataatgaatactggctgattgtaaaggcgacccatcaggtcacgctggcgaatggtagtagattcgtatacttcgcctactacaaagtgtttgctgatagagtcggtgcaagtaaatttcattttgattctcctttgttttcttgatgggagtatcttactaccccccgttattcagtgtcaactactttttacttgttgtattcattccaccactgggtgagcttatcaattatttttgtgtttctatccaacttctcccaccgttttctagggtttatcaaccggaataggtaaggtgtacttgttaagtgaactcggtcaatgtagtgattgatgtactgcttttcgattctaagtttcatctttttacgatgaaaatatgcaatgacttgttcttctgtttccatatgttcctccgtttcgatgggtgcattatgctataccccgatccgattgtcaacacccaataacaaaaaagtcgccactatgggcgactttgaacaaacattaatcatgaccgtgatttgcaatatccgctcgcgtcttatctttgtgatttcctacgtcaaagacacgataaccattttcacgcaaaactttaatcacttctgggttatcctcaaagactccgacaacttcatctttatcaaaggatttaattacctctaattttatgtgatagtctttacgggaatcggtacggcctctcataaagattttatcaaaacacaccccgttagaaattaaccaatcaattgtttccatgtaagcatgtgaacttcgtccggtgaggatgtaaatcaaatgcccgttgtcggaaagagcattaataacacgaattacatcgtaaatgggggaatcacccccacatgccttgttatattcgatccatgactcgactttatcaagattttcagttggcatctttgctagtcgatgcgttggatctgtgatcgtaaaatctaaatcgacaaaatatatcatagatatttcccgaatcggttgtagtcatcgtctgttaaatcggtattaacctgagataccagatacataatctctacttcctgcgctgcattctgtacttcgtcagagttcaaccatttacgcatccacggtaacggatgacgacgaacactaaacgggcttttcagtccggcagcacgcatacgggaatctgccaggtattctacataggttttcagaatttccggtgacaggttaggaattgcccccattgcgaataggtggtctacccattctttttcttgctcgacaacatccagaaagattttcgttgcttcgccttcaagttcttccgcaatctgtttccactcatcaccatcaacccccgtttgccattgacgaataatgtattgtgtgccttttaagtgaagttgttcatcacgcgcaataaatttcatgatcttcgcgttaccttccagtaaaccacgttcggcaaagctgaaagtacatgcaaaggacacataaaaacggattgcttccagtgcatttacgcagtgtgcacacagataaatcgaagccatcagatctcgttttgtatattcaaaaaatcttcttgcatcatctaatgctgtctggtcgtctcgttcttcccaatagcggagatcttcttttgcattctcatacttacgaatccaataaagaacatcatcataatatttcccgatagattccgctcgcttcatgatagcagggttatcgatgatctggtcgaactcactagccggatcaatgaaacagttacgcataatgtgtgtatagcttcggctatgaatcgtttcgctgaatgtccatgtttgcaaccatgtatcgagagttggatcagatacaattggaccaaatgctgcggacggtgcgcgaccttgaatagaatcaagtaatgtctgatacttcaagttttcggtaaagaaacgcttttcaacgtcacccatattaagatattgaatacggtcggttgcaagtgaaatctcttctggacgccagaaaaatgacaattgcttttcgatcagttcttcaaatacttgatgacgctgaatatcatagcgagcgatacccaacctactacccagaaacatcggttcgttcataatatcaacatgttcgcggttaaatacgctcattaattcacctcactatcactttttaacacaaaagaacttagtatttctgtttatttcgatatcctgctgcaattcctgcacagcttcaaaacaattttgatatgatgaaaactctacgctggtaacagttcctttattatatgatcctacgctaacggaaagcaataaccataatgtagccattagttcaccttttgtttttcaacgcaatatagattcataaagcgtttattgtcttcgcggataatctcgcgagctttaacgcaatcctgctttgttgcaaactcaatgcttgacatatttccgtaattatacattgaattgcttattgcaatcaataaccatacagtagccattatccgacaacctcaaaacatttatcatcaggaagaatcgcccattctacaccgtattcatcctcgacgtagtagcaagttccatcatgtcgagcatcatattcatcaccaacaacaaagctatcagctagttcaaaatctacagcaacacattttaatttggtcataataaaatcctcacttgtttttgatggttgtattatagcggggatttctccccgcgtcaacacttattttacagcttgcaagatgagcactcgctagcgtcttccgtaccatcagcaccatcacgcacgttagcgtaatacagggttttcagaccgtaatattgagcaaacaacatatcatctaacacatcagcaatatcgactttaccagtcttataagtgcttggatcgtatgatgtattggaactaatcgcctgatccacaaacttctgcatgatcgctgccagtgtcagataaggcttgttacctttcttgatcagtgtccaaagcaggtcaataacatcagcattattctctacgttcggaataacctgattaaattgcccttctttcgatcctttaaccgatacaatcccgcgaggcggttcaataccatttgtgctgttagacacctgagaggacgactcacaaggcatcagcgccgacagtgtactgttacgaatgccatattttttcaggtcttcgcgcagttcttcccaatccatctcatacaccggatcaaccagttcatctactgtctttttgtaccagtcgataggaagttcaccgcgaccatagcgtgtttcgtgcatcagttcgcaagcacccttctctttagccagttgcacactagccttaatcagagcatattgcaagcgttcaaacgttttatgcgtaaactcgttagcgtcttcatatgtgaagaaattatctgctagatatgatgcaaagttagtcacaccaacacccagagagcgacgttttttggctgtcagagcttgttctacaggataatcctgataatctaacaggttgtcaagtgcacgcaccataaccatagcaatgcgttctacttcttccatattttcgatatcgaaattacctaaaacatatgctgccaaagtacataggctaatttctgaatcatcacgacccatcggttttgtaggcagagcaatttcacaacacaggttagattgtttaatcggtgctacattacgaataaacgccccgtgattgttcatgttgtctgtgaacgctgggtagattcgaccagtgttaaaacgttcaattgccaccgctaaaaacaggtcttcggctttaacacgagttttacgaacactcggatctttttccagtttttcgtaaagctggcggaaaccttcctcatctcggaagtatagatcccacaacaagccacccgcaacatctggactaaacagagtaatgtaatcccgtttaaggaatcgctctaccatcaggttattaatctgtacgccgtaatcaagatgacgaatgcggttatcttccacccccttattgttcttcaacacaataagactttcaaattctaaatgccacattgggtaatagagagtcgccgccccgccacgaataccgccttgtgagcatgacttaacggcggtctgaaaatgtttccagaatgggataacgccagtatgacgaacttcaccatgcccgatcttagacccttccgcgcgaatcatgccagcgttgataccgataccagcacgcttgctaatatacttaatgattgcatttgcggtttcattaataccctgcaatgagtcatcactttcaatcaccacacacgaactaaattgtcgtgttggagtacgcacacccgccataatcggagtaggcagagagatttgcttattcgcaacagcattataaaaatcaatcacatgttcaagtcgattttctgtctcttcttgatgcaagcacataccgatcagcatatacgcaaattgcggtgtttcgatgattttcttagtgctgcgatcctgaacaagatatttctcttttaactgcatcgcaccagcataggtcattttaaaatcaagtttatggtcgatgaatttctccagatattccacttcttcacgggaatacttttgtagaatttcgcgatcatattttccggttgcaatattacgctcaatatggctataaaaatcaataggttggaattgaccgtatactgatttacgaagcgcgaacattgcaaggttacttgctacatattgataatcaggcgtttctacagtgatgttatctgcggcgaccttaatcaatactttctggatatcattggtagacataccttctgtcagaagtggttcaaccatatcaaacaattcatatggatcaacgttatgaccttcggctgccgcttccagaattttcattactttttctttttcaaacggaacagtcagaccggaagacttaacaacatttttaatcatattacctcacttcatattttagcaggaacaagtttatcctccatattgggggctttcgccccccttgtttatactgccattttagcggtgatcgctggatggctttgatagttgtgaattttaaagtctttcggagtctttgtcaatacctcatctaaagatttaaattccggcaactcaattgttggtttatcaaacggaacacggcttaactgttccataacttgatcaaaatggtttttgtaaatgtgagtatctccaccagagaaaatcagttctcctacctcaagatcacacattttcgctatgatgtgagttaacagcgcatagctggcgacgttaaagggcaagcctaaaaagctgtctacgcttcgctgaaaccacatacaagacagtttaccttcattgacgtagaattgcacgaaaggatgacatacacctaacacagcattatgcgtttcctgtacgttccatgaatcaatgataatacgacgactatatggatcattcttgatcatgtcaataactttttgtaactggtcttcccaaatcttcgggcgatagacatattcttcatcgtctttagtgcttgatgtgtctacgtccatactaacaaacatcgtggtatccggtgctataatatccccacccagataatcactatcaagcagataaccgaaataaccatcatctacccattcctggaatccccacaagcaatatgcatcattaacaaaattagattgagtcttccagtggtctgctaccagaatataatcaaactcttcataacgcataccacgccagatagcacataaacggtcttctgtttcattggttggcgtaaagtcttctacccacgggtgtttaaatgtatgtgtatatttgctcttaacgcgcttaattttgatttcaccatgtggatgaatcggtttgcgtcgccacgccataccatacatattgccgacattataaccattgaatcgcaaaggattcttttctttcatatcaagacagttgccgcgccaaatgtcgaaggcttcttcgtcaaacttaccgcgtgtaatttcctgtaagcgacggcggtcaagtgatccctccataaaccatagcaattcgccaattacagaggctgtagccatctttttcgtggtcagtaatgggaaacccttgcttaaatcaattcgcatctctgcaccgaatttagagagcgtacctacccccgtgcggtcttcacgaggccagccattatcaagaacatcacgcaacagtttcaaatattctttcatcccacttcccctttttctttgctttcttacgcagttttgctactgtctcgctaatgttaataaaaatatcgtctggaccgaatacagtaacaggtcttgatatatcgctattttcttgtacaggaaaccatgacgctttcgattcatcatagagatattgcaacccgtaaagatcttctgctactgcgtagttttcattggttgccgaccataatcgaataatactgattttcattattgttcccgtccgcagtgtaaacaccgactacaaacaaacatcaaagattcaccgcaatgtttgcactcataatctgtcagaattttcatgttacgccttcttacgttctaaaatttgttcgctgatcaggtaatcatcaaggaagtaattatgttcttcttttgctgcaaagtcaaaatataattcctgaatcatttccttagagataccaacatcatattcgaacggatcattaattcctgctcgttgaacatacgttaacacaatacggtccgcaaagtcaaccgctttttcaatcagggaaggtccaccaataacgcttaccaaaccttgcaatttctctatgacttctaataattccttcaatccaccatcattagtaatcgcggtatacacatctggttggtcgccgttttttgctttcggtgctggcttactggtatcggtgctaacaaccacattcacacgaccttccagtgctttaggaagactttcaaaggtattacgtcccattacaaccgccgcaagatcaacatctcccatagtgcgcattttaaagttttccatgtcctttttgattggacgaccccacggtaaaccgcctttaaaaccaaaagcccaattttcatctgacattttagtgtcaccgatcgcaaatacacattgaatcataatataaatctcccatcaaatcagtttgaaatagttttcgtttacattttcttcggtgattgctgtcttaaattcttgaccgttatccggtgtgatgaaataacggtcagaataatcacgaaaacgttttaagtgagataccccaacattaacaccattttcccagaaacgaaaggtaatcatttttggttcgtatcgatagtcgctggttaacacagtaccatccccgcgacgggcttcataaaccgtaatacattcacgattggcggcttttaggcattcttcaatagtgccacatgagataatacttactttttcatctacgatttgttctacagtccacataatataatcctctctttgtttcgatatgtgcattatacactattgcgttacgctgtcaactctttttcaaaagattttacgatatacatgatagtgctcaattcggacggcgctactgtctctgtgtagccatccggcatatcttctttcgagatataggaagttttacctttcattgcttccttgatcttgttctctaattctaagatcttttgaccgtcttgtaaagtcaattcataaaagatctcgtggtcgaatttagactttgatgattggtttttcattcgttcattcgtgtctctgtttgttattccaaatttcacaccaacaaaggaatcatcgttggttaatttctgtatataaagagtccccgatttttttgtattgtatccatatgtagcacactttctgcaacctgtagtcccatgtatgactctatgtattgttgttgtccatatataatcacataaacatttaacatcaattttagtttctgtgtttttccattcttcgtggatcttaattattacataacctaaagaattgcaaacttgattaatctgtatcattctatcgtcgatagacaatctaccaacacatacaggacagcgagtattttgatacacaaaatgtaatatggaagatatccattcatgaccgtgtttgcagctaagttttatttttgtgcggcatcctttccactcaccaacaaaacctaagaaaattagattttcagtttcacatatttctaaaattctcgtttcgtattcgtcttttgtcttgttctttcctgcgcatgtagggcatctggtattcatttttgtgaagctatatatagatacatcccattcatgaccgtatttgcattttatgcgaattttagtatcacaccctttccactcaccaacaaaacctaagaaaattagattttcagtttcacatatttctaaaattctcgtttcgtattccgtttcggatatagacaattttttagatattcgtttacctttacattgtttatgagaacatcttgttcctttacttacaaatttatctatcgaacatatccattcatgaccatgtttgcagataagttttatttttgttttgtttccttcccaatccccaacaaaaccgacaaaaactaaattttctgttttacatatttctaaaattttaccataaaaatcggttgggcttttcgctctacaattatgtttctccttagtccattcaatttcatgtgcttgacgtaataacataattttatcctccgttgtttcgatgagcgcattatacattaccacatcagcatgtcaatacattttcataaaattttaggcaataaaaaagcctccccgaaggaaggctttaaaattcattacatccctaacagagcgtcaagatcatccagatgagaagcggaggaagtaccgccacccagatccagcgatgccatcaggtcatcagcggaagaatctaacgccgtgctagctgcgttaataccaactacagtgctagctgcgttaataccagaatcgaatgcattcatctgtgcgtcaaaatcgtcaagctggctgttaatcgctgccgcagcactggaagccgcagcaccagctaccatagaaacgcccatagttttcttaaatttggtttccagttcatcgaacggtttaaactggctaggcgctacaatctcactcagatcaaccatgttttccatcagatatttctgatatgcttcgtcttcaattttcggaagctgtgattgctgcatgaaacgagaatcatcatagttctggtgtttatcaaccttcttagctttcaggaggaagttagcaccggagaacacacaagttacatctaccggaacttcgcccatgtcggtattcacgttcaccattgcaacgatcttatcataaattttctgaccgaagcggaatttgaataccttaccttcattttctggtgcttgaggatctttcagcaccagaatatttgcgtagtaagaggctttacgcttaatcagttgccattctgttttatcggtattgtacagatctttttcgttaatatatttgcacacagggcaagaatcaaaatcaccgtgggtgctggagcagttttcccaataccatttgccattaactttgaaggaatggtttaccagtttcacaatcggcagaccgtcttctgtcttagacggcaggaagcgaatcagggcttcaccgttacctgctgcatcagtcttaatcttccactctttcggatcttctttggagaaaccgttgccacctttcagtgcggccagttgagcttgcagtttggaagaatcttggcgtttaaacatattcactattccttcttttgattaatttactagactattatacagatttaaatttacttgtcaactatttgtttcggcttttaattgagatatttctttacactctttaactactttaacaaataatgctcttgcttttgcggcgtcaataacaagtagtttcttgtacgccttcattttaacactataagtttgccaaatcaagtctttggctaccttgtcgtgttcgtcgattatatttagaaagctatctaacaacataaacgactcaaacgatataatccgattttgcagtagtttaaagataccgctagtttcggttgcgggattgtatgtaattagctctttaagagtaaccccgcgtttctctgagaagtataccagacttttaatgtcatcgtcaaatcgtgttgccgcatcagtgattttaccgatgtactccatgtaaaacccgtatgcgtcaacatcggtgatttcacctacccatgcatcggtattagctaccagattgcttaggaataggaagtataattctcttagattgtacttttccgctaattttgcgaaataatacttatctctgcgtttattgaatgcggcatcagacaaccgcatcctccaattatattttacgcaatcataacgcccgttcatatgagctttcatcatgcaatataacatatacacagatttagcattaattcgcatatctggttctggaggaagacggtttctgatcatacataccccttaaatatcgagagtgttggtcggttcgtcgatcactcccttcctgagcgttctatttactatacattcttgtgtgatcttgtcaataatggacaccggaatatacttctgatagtgaccatattcgatagagttttcctctacaaactgcgttgtcgcttcaagataagtcaatccctcttcaacaaccagcttttcgattgcaagaccgtttgctgttttgttcgcggcttttaccgcatgttcattaagcattgaacacccgatcatagagttctacagcttcatcgcgttctgcttcgaaggtttcgcgctgttgctggtgatacagtttaaacagaatgccccacattttaccatctacgcctaattcttctttagcacgctgtttgatctctttgatcttatcgccgtatgcttcttgaatggttttctgatcgctggcttctttaatcagttgtgccagggtatttccgtgtacattttcatcgaatactactttttcttttttctgttcagtcataatatttaaccctctttcgtcattaattgaaaaccacgttcagcttttgaaatttcgctaggacttaaatcgtcacccacatattctagcatcatttctcggataatgtcaagtgctttttcatcacctgattttaactcgaactcaagttcatagtgagcatctcccatgacttcgccgactttgcaataatagaaagtgtctttgcacatttccactatagcaccctcaaggtcaagtgtcaatgacttgcggtatgtcattacttgcaataaaggaacgataaggtcggagtttacgcctagactatcaacatagtgatagaaatcatccgttgttgaaaaagtaatttcttctcggttgaagagtccagattcactatcacctattttgaccatgatcaatgatctattaacgtcaagtcgagcataaattccttttcgacgtagtgcatgatcttcggtatcataataaaattcgtgttttagagtgttagcacgatctactagattgtacccgtcatacattgctacccacaaatcacagattgtttcgacgccaatttgtgagtgtgcatagtattttaattcaagttctttcatatgtcatcccttagaactcaccaattttctgcaacattttaactaacgcatttgttacaaaatagttataaattttaccgcgtggtgctggtttagatttttcccatgctaacaaaatttcatattcgatgttatcgggaataaattcgaaatcaataagttcgcggttttcgtcaaaacgtcttgcttcttcctctgtcatcaaagactttggatcttcggcatcgaaaatttgctctaaccatttggttgcaattggtttagctcgttccccttccagtcgtgagataatgaaatcactacggcacttgatagaagctacaccgtcttttgcgtcacccttaacacattttaccataaggtctttgtaagggctaccatatttgcatttcttccacgctttctgtactggtgcccactgtttcacgtttttgtatttgtgcaactgtgtgtagtcaccatcgcctgagttgatcagcacctggcgaccttcgacagaaaactttttagttaacacagcgattatatcatccgcttcaactttgtcaaccttaataacgtgataaggcatgttctctttaaactcttcggtgatcttattgatcgcagcaaagatcatctcccaatcacgcggatctgcgtctcgtttttccttacggttgcgtttatagtaaggggcgatatcacgtcgccagtaacctttgcttgaatcaaaagcaagtaccgtaatagggtattgctctttgaattttgtcatattataacgcatggtgtcaaggataagatgacggatcatgccttcattaataggatcttccggtttaaaggtatgcgagatagtagcaatcataagctgcgacatatcaatcaaatgcacaccttccggcagtttatcttctggatcatcgaagaaatcattaagtgtagcggtcgtttttgtaaacgggttatacgtcataattaagttctctccactctcacaacaacatattcgccaaacgagttagatacttcacgatcatacccgtatttctccataactcgcagaattgcattgtttaattcggcacggaaataattataatccttatcagggattctgtcaactacccattttgcaccttctgacaaatcaactttaaccataatatatcatcctcttttgtttctatcaagcctcattttataaatatgaacatactataaaaggagacccaataatggcagatttttctcaacatttcaaggccacatttggctttgacgctggtaatgaaaaggtcgtcaatgtagcattggctgataagaatgtcaacaccgatgcggtcaacgttgaatttttcaattaccataatggtattactcagtatgacacaactcgcggttatgatcaatacggaactacaatctatcaaaaccgtccgtattatgcaaaagaagatatcacaaagccagcaggtgattttgacccgactaaatggcaagcactgcgcacggacccacgttgggattatattgcagcaacttccggtgatactcctttacagtctggtgattatatcgcagcagatggtcaatttgcaaacttgactttctctatgccaactaaaccagcagagggagacactataacagtaaaagatatcggtggcaagtgtggtgttaacgaattatcgttcttgagtacaggacatgagttttaccataatggtaatgtatataacagaaaatggtattgcactaccccgtatgcaatgaactatttcatctttgttcggaatcgttggcatgtttatcagacaggaacagagccacgcggtgtgtacgcacagccagcgattgatgctattcaaatgcagaatggtgatcaggtatttcgtcgtagttcgttgggtaatattaccttagtgcttcctaagtttgccaacaatggcgacatgatccagactacagaccttgacggattaaccgcaaccaaccacgttacggttaaagttcatgagcacgcagaagaacaatcaattggcacgtccggtctaaaagagattatcggtaagcgtagcggtcatggtgtattcatctttgacaagacggaaaacttatggcgtttgtgggatggtgatcagtctgttcgtcttaaaccgatcatcaatgacactcgcttgcaacctaatagctatgttgctgtatttggtggtcgtgatgttactctgacgctgccgaccaatgtcgagccgggtgatcgtattcaagtttctatgcagtatatgcaaggaaaccagaattgccgtattatcaccgccacagaggatacaaaaatccttatgcagaaaaacatggttcagtttcctaagcgtagcgagtacccattcaatgggaccgatacatggacgggagtatctgaattatctttcaacgctgcaaatgattatgtaccttatctggagttctcttattcagaaggtgatgatggtaagaaatactggttggtggcacatgctcacccgattgtagaacgagtagatccgactcgtaaagatcgtgttggtgtaattgcactggctacccagactgaaacgaataaaaatcatgaagataatcctagcgacgaagttgcggtgactccaaaggttctggctaataaaacagccaacgaaactcgacgcggtattgctcgcattgcgactcaagcggaaacgcatcaagatactggttccagcttcctggatgatgttatcgttacgcctaaaaagttaaatgattgtgttgctaccgaagcccgtcgtggcgtgatggaaattgcaactcaacatgaaaccaacgaaggtttagacgatacccgcgcaataactcctaagaaattagaagaacgtcgcgcttccgaagatctcgctggtattgctgaaattgttcaggttggcggtagtgctgccgctcgacgtggcgaagctggtacagggatctataacatcaacgaccatgctaaaattgttacgccacaaaacatcaacgaagtcaaggcgaccgaaacttcccgtggtgttggctatctggcaactgacgcggaagtgcaaggggctacagaatcaaccccgcaagatgctttactaatcacgactcgcacgctaacgaaacgtactgctaccgaatcgcgcactggtatcgctgaaattgcaactcaggaagaaacaaacttaggtcaaagtgataaccatatcatcacgcctaaaaagctgcatactcgccgcgcaacggaaactttacatggtttagcagaaattgcaactcaaccggagtttgacgcaggtcgtgacgattctcgcatttctaccccattgaagattaaaaccttctttgagaatgcacagcgtttgaaagtagatccgactcaggggcttaaccttactggtgatttgtggcaaggtatcatgatcagcggtctggatgcaaccgaagacacaaaaggtgtcgctaaagttgcgactactcagcttactgacgctggtcaagatgatactacaatcatcacgcctaaaaagctgcaaggcaaaaaggccaccgaaggtaaagaaggcattatccgagttggtactcaagccgaaaccgtggctggtattatggacaatgtagcaatttctccgaagaacttcaaatatgttgttcagacagaggatacatggaaagcaaccgaagcgcgtcgtggattcttgaaagttgctactcaggaaaactgttttgttggtgataatctgcaaggttctactcaagaactaggaaactaccagcatgacggaattgctgttaccccgaaaggattaaactacgcacttgctaatttcttacctaagatggcaaccgctcagaatagtttgaaattgggtaacgtagaggccgctaaatgggcgcgtagagacattgaccagaccatagagagcaattacacgtttaataaaaacgttaacgtgacgggcgatttagagtgcttaaaatcaggttcctttgaaactctgtctgtgactaagaactcgactgatgatccgagtaatggtcatctggtgttgggtgagcgtggagttgacggtcacaccggaattactctgcatggcacaaccgcatcggaaggcatgaaaaactcttggtcgattatcgttggtggtacgggaacagcgcaagttgttgatagtgatgctatcgctttcggtaaaatcaatgatggtggagtcgttgagcattacgcctttgctatgaaacacaatggcgacgcgacagcatatagagactttattgcaggtcgtaacctgtatgcgaaacaaggcggtttatacattgttgaccagtctaatccggcaatgactcgttccccagatggtatgctgaatatcggtcacggtggaagtgttaacatcaaggcaggtcatcaaacgttaactacagagatcgccggacagaaatatcagatcgtacacgcaggaaacgctgacgaagttcttaaccgtcagtttgttaagaatgctggcgatacaatggtcggtaagctgactatggataatgcgcctattgtttctgttaagcatgaagctagcgcggcaaccgctccggcaatcggtaacatcggtttctggaatatgcgagttactacccagaacatcaaagaaacttatccagagaagaaaaacggtactctgatgcaatggggtactgacgcggacgggcttacccagctttggtcccccgatggtactcataaacattatatccgttccggtactggtggtcaatggaccgcatggggtgaaatttacaccaaacagaataagcctaccgctcaggaaatcggggcagtagttgcagaaggtggtttaatgaactctatgacggttcgtgattggatcaaagttggtaatgttaaaatcatcgccaataatctgactcgtaccgtagactttatctgggaagactaattaaagggggcgaaagccccctatggggttattatgacacaagatatagaattacgcaacactggaattaggtttgcgcatttcgacgaagactctgcgacatttaccagcatttcagaaaataactctgtgatgtataagctggaagtgcgcggatctaattcggattctaccaaaccagcaaggattagatttaatggagtggagatcgttggcactggctatgaaaatggcctaaattttaaagttcttactccaactggacaactacacgaagaaaaggtattctatggtcgcggtgctgttttggcaatgcgtgattatctttctttgctgaaaggtgactatatcattgcgatggcaacgcatggagaattgtttgcagatccgataagtgatgttgtattttctaagatgggatctgtatcattcccgaatcacattttgctacagcaaatgcctcgtgtatcctatgcagcaatttattctactaaaatgggtaaaattgtgtgtgaagggatgcaagcgaccaacggggaaggacaagattcatctatacaaattgagaaagtctatgatactatagatgatcttgctataacaggaacaccacaacgatttttagattatccggttgagtatgttagcgaagatgccgaacatttcgagctaatacaatggcctcatgatgagaccagcgccccacttgaggattttaacataaaggcaggtgacaaactatcaatatcctttgaattgttccgtgatagtgccgcagccgcagccaacgtaacagcgcgtttctatcacaactacttcaccgatggacaatatcaaactggtgttcgatacaatgccagcaaaaaagaccaatgggaaaagtttgaagccgtctataccgtaccggaaggagttgatagtgtagtaactggttgtatcagatatccaaccaactccaatgaaggtattgttaaaattagaaacatactaataacgccgatcagtggagtcgtcaaaactactggtcctacttcatttggtgttaatggtgttagaacaactcatattcaggataacggtgattttactaaccctgtaatgagtcttcttaaactgcctagagataataaacacatcacatccaacaactttaaagagttcgatgttgattaacatttttaacaagccgatccatgtggtcggctttatttttatacagttggttaaattgtaaccaaaacgaagaaagatctttagaatatagaaaagtttgtttcggttaaaaattagtcagtgcctacggcacgtcgcgaagcgatatttttgttaacattctataaatactcggaactataactaatttttgaggttactttatggcagatttgaaatatggatctactgtaggcggatctcccatttggacgcaaggaaacttgacgatccagccagcgggggatcagcttttctacaaaggtcataaaatctataccgcttttgatagaccttcggctaccgattttgatgctgttagtgcatccgaaggtggcacatttcaaaagcaagttcatttcgaggaaggtttaagcgtaggtagcgcatcggctggagaaaccaaaaagaatggtatctttaaagggcagagtgacgctgctaattttgacggcgtaagctggggtttgcattcatggaagtcaatcggctttgttaatgcccgtgatggcgttatcatggcgtatattgacaccacaacgggcgaatttaagtctaaagggactatcgaagggacaaccattaaagacacaggtcaacgcgtctatagccctgttaataaaccaacgaataatgatttagatttggtgtctcgtcgcggtgatactctcacaggaacatataatttaaacactgtcactgttaaactatcggttgattcgaaattaattgcaagggaacgtgatttaattaattttgatgcgactaagatctattatggtaacgttcttgatacgttggtcttccgaagtaaagatgagcctaccatttttgttaatggcagagaaggtcgtttttatcacaccaacaataaaccaactaaagccgatgttgggctaggcaatgtcaccaatgatgcacaggttaaacgtgctggtgatattatggaaggtaacttgcaagcgcctagaatgttggcgacaaacgatcctgctggtcctaatgaattggttcgtttgagctactttgagagaaaatcaatggtggcaaatccaaccatcattggaaacgttgattggaacactcttattaatcgcggtatctatcgtgtggaaaatgctggatcaggtactaataaaccgtctgatagctattataacggcgttttgatggtatatcgcccagaagatgcggttggtactcgtcgaattgttcaggtgtattatcctgaatccattgaccatccgatgtgctggcgttcgtgttctaatgaatcatggactgcatggaactatgtagatcaccgtaaattagccgatattcgctatgttaacgtaactggcgataccatgacaggaccgttaactgttccggctgcaaacggtgttagaacagctaaaactaactataacggggataactgttatgcggcgttaagcggtgctgatggtactgctatgattcaccgcattagtgatattaaagggaccgaaaagctggggatcacccacgactcaaaggtcgtgtttttccgttctagaaacaatactcaaaccgtggatcgctatcagctttatcatgaaggaaataaacctactccggctgatgttggcgcagttccacttaatgcggtgattgattttggtactttctaattttagcggggagacgatccccgcttttctaaataatattattctaataaccgtttaaggattttataaaatggcagatttaagcagaatccaatttaaacgcactagcactaaaggtcgtaaacctgatgctagtacgatgaatccgggggaattggcaatcaaccttgcggatcaatatcttcttactaaaaatgattccggtgctattatcaatttaagttgtcctccggtttatgacagcgatgttacaatggcgggtaaggttaaaggaaataattatattttaagtaaaaccgctaattattttgaagaccaaaccgcgcgagatcttaattattttggtgcgtttcgaccgaataatgctgatggttggtctaacttgattctgaacattcctcatcccagcggtaaatcacacggtcgcgggtttgaatttgaatatggttctagttcctctcaggttaaaacctatggctttgataaggatggtaacaagagattcagctttcgcatgtatcacgaaggtgataaacctactccctcagaattgaacgtctatagcaaacaagaaattgaccgtatgtttgttaagaacgttaaaatgtccactccttctggtgaagcaacccgtggttattttaaaattgcatccgcaatgatcccgcagagtggtcggatggcgtttctgcgaatctatggtgggaacggatttaatgttaactcctacgatcaggtggatttccttgaaattgtgattcgtagtggtaataataaccctaaaggcgttagtattgctgcatatcgtcgaaattctttgaacgtccatgaagtatttgcaattaatacttccggtgataactatgacatttatgttaactatggtcgcttcaccgataacgttattgtagagtttggaaaaactgttgatgttgcattgactgttcacgatgttcctgaattttcggcgactaaaccagaaaccggaactaaatttgatgctcgtgttattactatgttcaacaccgaaaacaaagccggaacgttgatgtttgataataactcacaagcaacctatgatattgttagccttaataacgtaccagacaacaataaaaaatatatgcgtaaattccgcagtcgtgcggcggaaacaatatggcatgaaactgttcaaggtgatgtttatcgcctagcgacaggggctaccgatcagaaagaagtgttaaagattgtaggtagtgatggtttatttgtcaatagacttcatctgcaaggcaataacgcgattcgtatgtggcgtcctactggttgtagtaactattttgaatatatggatcagcgagacggggctaataaacgtcaaggctggtttggttttggttctacagaaaccaacgattttcaatggtatagtgacgaaggtaaaaactttgttaagctagaagcaagtggtcaagtatctttaagcgcaggtgcaaccaaaattgtatacactaatggtcaatatgtagctgccaattctgatgcataccgtatgatctttggtaattatggtgcattctggcgtaatgacggcactaaagtttatcttatgtctactgccgaaaatgatagatttggtggctggaatgcctatcgtccattcatttatgatttaacttccggtaacgttcaattaggcggtgatggtaacgaagatgcattaacgttagaaagtgcttctcgtgccgctcgctttagtaatgacgtttacattaagaaagggcttttgactttcgacgctgggcgcgctggatctcgcgattatattcgatttaatcattggggtgatagcaataatgctcgtgataacgttttgtacatagaagatagtcaaggccgacattttagcacagaacgtgctatgggtactggtgctcttaaagcctacttcttaggcgatcttgaagtcggtggtaagtttacttggggtaaaaatacagctacatctagctttaatattcgtgcatggggtaatgattctcgtaagcaagtattagaatgcgcggatgaaagcggttggcattggtatacccaacgtccgggcggtccgggtacttctgcaattgagtttgccatcaacggtactgttaagcctcaagcaattcacactggcggtaatattcttttgaacggtgctgatattgagtttcgtcgcactggtaataagcacatttggtttagagacccgaacggcttagagttaggcttgatgtactccgatgatgctggtgttattcgcttccgtggtcagaaacaagcccagacgtggaaatttgcagataaaatgatccagttggaatctggtactgtaacaggtggtggtaatggcctgattcgtggtgaagttgctggcggtagttgggctagctggcgtgaccttgctgctggccttatggttgggtgtcctcaatcaaccgattccgctcataacatctggaaagcgacacattggggtaaatatcacattgcagcaatgggtgtgcatgttcctagtggtactatcggtaatgctatagctcgcctaaacgttcatgacgccaactttgactttagcgcctccggtgacatgtcggcagggcgtaacggttcgtttaacgatgtttatattcgttctgatgctcgccttaaaatcaataaggaagagtataaggagaatgccaccgataaagttaatcgcttgacggtatacacctatgacaaggttaaatctttaaccgaccgtactgtcattgctcatgaagttggtattattgctcaggatcttgaaaaagaattgccggaagccgtaacaacttctaagatcggcgatccagataatccagaagagatcttaacaatttctaactctgctgtcaacgctcttttaattaaggcgtttcaggaaatgagcgaagaattgaaagccgttaaagctgaactagcggaacttaaaaagaattaaggaaaactcccagggaagggaaactactaaggagaaacggctatggtctataatatcgtcattggtgctttgtctagtttcgggatgaaactattatcaaagttaattagtgaaaagatgctcactaaaattttcttctattgcgctcgtcgtcttgcggcctataccaatacgccaattgatgatcgttttgtggaagaactttataaggagtttaataaagatcagtcagaagatagtaacgagcaagataaacctagtgatagtcaactacctaaataagagtacactgtcatagttatcttagggcattatatgcaagtttctgaaaaagggaaagactttgctatctcaaatgtcctgcgcgctattttcacaactaaaagcacggagttgctcgtacttcgtgtttttgctgccgtcgtgttgtccatattggcatttgtcgtttatagtaaaaacgagttatttgcgctttataaagagactcgttatgagacttatgctcacattctccaggtagagaaagaccgcaattttgataatgcagcacaggagcagttacagatagttcatgtgtcggctgatgccgatttttctgctgtttttagctttcgtccgaaaaacctaaactattttgttgatttggtggcatatgaaggaaagctaccgcatacgatcgatgaaaagaatttaggcggattccctatcaataaaacgagtgaagaatatcgtaggcatcttttaggtaaatcatattttaccgataaagatttccagtatattccatcgagggagaaaaaattagagaatatcgatatagggtttatgtattcttgtcctatattcaatctcgataatgtctattctggtagtatcgccattgcatggaagaataaaccggatattgacattgagaatttggatactctttgcaatcaatctgccagaatcctcggaaggattagataacttaaaggggaagcctttcggcctccccttcttttttattggcgcatagaagcccctgaatcacattttgacgctgtatgatgaaaacaggtagcgtaccagtcatcggcttgtttgtcttcgtcagaaaacgcgtaatttcgttgtatgccgttttctactttgaccagcgcaatagctgtttctggaagatcaatcaatcggacaaaatcgccatcttcccattctacacgagcaatatcataacccatctcaaagtatacaatcgcttgttctaatttcattctggaaacttcccgtaaatgttctctgccaacatacgcgcatcgctaatgatatctttcatgctatgaccgtagtgttcagccattgagttgacacaatcaacaaagaaattataacggcgacggtttaagatttcttctctgctatagttttcatatttgacggtcgagtgtgctttctcgattgccttgattgctatattgacttcattgataatggttttagcattgtatgcgccacgacggatcaggatatttgtcaattctcttgcaatatcttgcaattcttcatattcatgttcaaacataatcaacctctcaaaatacaatccttacagatgaaaacctgttacgatcaccgcatcgatcttaccgctaggaataaacggttcgccctcttttatttcaactttgaattgatgccatttcgctaatacttcttccggtacacccagcgattcggcgtctgctttagtttcatccataatccaactaggctgcatgagagcatagtttacatagtccatttctggggtcatgtcatcaatgttaatatatttgcagttgacgcgtttcagaatttcaaattctttattgtcaacctgtaccatgtataattcagtagtttctggaatcagttcccacacaatcagtacatttttcatagttcacctcacttaacaaagattttctttaatgctttcaggatcgttgcttccggcgcttcttccggtggaggaagcaattctaccacttcctcttccaactcgatatagtctaccagatattctacatagaatgcaagtgcttccatgaaattagatgctacatccgattccccacacgcgcccacatgcattgtataaacatcactgcgatcaagtttgtggatgcttcccagatagtttcggttataccagacttcccacactttcaactttccggtttttgttgatgttttataatcggtttcgtaatgatgcaattgacgttgcaaatcattgataataacacatttttcgtaattgttttgaatttccatgatgtaatcctcacttatcgttaagaagttctaaaactttctgtcgtactttgtcaatattagttgattcaaaaactgtacggtatccccagctttgaccgtatgatcgcgagcaatccccatatccccattgttcaacctgatagtattcaaggaatggatgttgccgaactatgataccatcgcgattaaaaattaccataatataatcctcacgtcaacaacttattttcggttgtggtcacgatatgttttaaaatatccttcgtaccacggtaaaacatctggatttttaccactatacagacctttaaccatcatgtcaataagaccgtccggtgtttgataattaccagcttttataagctctctgattaaaatttccctgtatatgtctttcggatcttcgtaatcaacttgtatcgtggttgttgtctcgcttaatttggtttctggagtatcttgcatcgccttccaccaatcttttgtaatcttcatgttattgaattgcataatttaacctcttacttgcaaacgtattgatctacatcaattgctccaccgaatgtaggatgacgtttttcaaatcgaatagttccgtcgtttggttcgaaaacggagtattcatatagatctttcttgccaacattcttataaaacccgcctttagtcataacggtttcttgtacgtttgctttgtgtacgttgtattcatcaatgtatacaaaatcaaccatcttcccatttttaatggttactttaagatctcctggttgatttccatattttgcatacagtggcgcttctttaatttttgtggaaattccatctttcatactccactcataacgaacggtgcattgataggtaaaagtttcgaccttcggttcttctaccacttttgcttcctgtttcggttgttcttcttcaaccttcgcagaagtctctgaatcgctttctgacgcggtttcttctttaggtaatacattcatcaagttttggatttgagcgttgtatacagcctccagtggctgaatctgcccgatattgatcattgtatcacgaacagttttattccagttgcgttgctcttgtttcagagacggatcaatcttaacagccttaacatatacttcatgaagtttagaatccagtgcggagattgactcattagcacaaataaacttctctgattttgtagtggctttagcgcaatcaaaggacgcagcattagcaccgaaagcagtagcggaaagaacgatagcagcgataatgtttttcataatatattcctcagtgttttttgtcttgatgggagtatcttactactcccttaatccggtgtcaactacttttaaattattttcgccattcaccggaaacaataaagtttgtaaagtgatcgtggtccgtgataacgtcattaagtaccatatgtggatacactttagtgataattttactaagtaccatatgcggatatgctttagtgtaatcacgtttacgatcagtcatccagccaacgaaagttggtgcaaagtacggtacaccgtcagatgatgccatattaaaccctttatcaaccataaatgcagccgccctaagatttttaattgaagtagtgcgactaatttcaaaaactttatcggtaaaattcattttaagcccccgctcgtgcattaatacgcattttctgtatagccatgatctggtttactgcttcttctttacgttcttgcgtgataatgtgaccagattccgcaaactctccagcaacttcttctacgatctcgcgaacttgagaacgtccaaagatgcggtttccttcgtagctcataaactctgttactacttgctcgatagatttcatgtgattctccttctttcgtttcggtgtgggagtatgttaatactcccatttctttacgtcaaccagtttttagaaatttttcgcttcttcttcggtcatcatcaccgcgcattcgtgcataactttgaaaaccgggtcaatcatatctaatgcttcgcgggacagtttacgagaagcgattttgattgcttcaacgtcttctactacaggaacaaaaacagttttcagttcgtcgagcacggcagcttctttttcattcaggaagatcccagcgtcatacagtgcaacttcgataacattaactttaaccattttaattcttccagttcgtttcggtatgggagtataatactaccgatgacctttggagtcaactaatttttgttattttcgtgaaattttttcgtcgcctcatgtgcttttcgctgggcttcttgttgtgcttgctggcgtgctgcctcttgtgaagccataacggaagcatttgcagcagttacagccgctaccatcgctgcggtgttagcatttacagtacatgcgctcgccaacaaagcaatcgcaatcattttcttcatagtttcccctttaggttatcttcgaccttcacccattccgcgtattcttgcgcggctactttcggatttaagccgtcttcgtacattgcatcaagtaattctttgtcggtgggcttataccctagataagcctccacctgatttttccaaattttataccagttcatattatcaccagtcaagagcgcgtgtctctgcgtcttcccatgcttggtccataacagccttgaaaacatattctaaagtatcatctttagagaatccgaagaccttagacggaatatcttcaattgctactcccgcaacttctgcattacgcgcttggcaataatgcaactctaagttatcgagatagcgaccgcctaatttctccatatcatcccagcatttccagtaacctactttatttgcaattgctaacactttgctgttttcgttgctcatctttgattctccttttgtttggaatgggagtatattactactcccattattcagtgtcaatagattttattcgattatttcaaattttgctaccggatcaccgtttcgtttggttgcagtaagttgctgtttgtcaaagtaaaaccaaatatagtcaccatgaactacatcaaatgtgtttccgctattgtccgtgaatacatcaacatcataatcacacccaacactaaagctataattgatgtgatcggtttcaatgcaacgtactttcatttttgaatctcctttttgtttcactgtgtgtattatgcaatgctggattatggaagtcaaacaacttttcaaataaaaaagccgaccacaaggatcggcttaatagtcagttacttactaaatttctttttggcttcgtctactgcatgagatgccagcaccgctgccgcctgtgcacttttatctgtgttgcatagaacacccagataaacatcacgccaaagtttaatcatctcgtagatcatatcaatatcattttcttgtttgttggcgatgctattcgtcgttatctggtaaggcaacggcttgatctgtactggttccgccatcgggctaatcggtttcggatcagtcatcggattaattgatggcgatgtttcccatacgctattattccacggtttaacggttgtatcgtacagtttataaggatttttatctgggttaaccatccatgcatgatgattacccaaaccatttgaagtgatgcgtcgttcagtcatactttccatccaaaaattctttcatcaaataatctatcgttgctctgtgttctggtgtgtttgttatctctgctaacttgttcagagattcaatagtgatccggttggcttcttccatagtctcaacgaccattggtacaaccttttcattgttgtacacgaaagccacataaccacctactggatattctttcataatcaacccttcttaagttctttaagatctttcttatattccttcattgcggtcgtctttgtccaatactcatattcactatgatgtttatcggcatctttgaccagtcgatcatactcttcttgagtaacgctatacaatggcatagaaactagcttatcggcgtatggacgcagtttttcatgtccattgatggattgcattacctcggcctttttctttccctgtagctcgatttcgcccttaattacgcgatcgataaattcggctttagccattgcataattgtatgcttccagcgtttccgcttgcatcaattcaatgcgtttatcgacataccctaagcgaatttcgacgaatcgacggatcagatcgctcgctttctcgaatacttctactaaaccacgttcgttaactactacgatattctgggctactaactgcgttagtttaaaatccttcatgatttgctcatgtcgagcggattcatcttcgcttttgaaataatcgcgtttcagtgttacttcaaatctgaatccgtccttagagcaacggtcattatacgatacaatcagatctttttcttccagtgcatccagtaccgctacatattcttcacggtcgaacttataaggaacttctgatattgtcagtttagtcttgccgtttagttcatatgtaccctcaagaatcacaccatcgcgatcatctcgcgggataactttacccgtgaatttcgggaattgaacactaggttctttatccagttttccggcaagtgctagctctgtgcattcaatgaggctttccagtgaatgcggtaaaatgtcagttttataccctgtagcaataccactaataccattagccaataccattggcacaactggcaagtagaacgctggcgggatgtgttccagatcttcgtgcttgggtgcgcaattcatatctttatagattttaaagaagttttcatgcacgcgagcaaagatataacgtgccgcacctgctttctggactaaacgcgatccgaagttaccttgaccgtcaagcagtggagtattattgctccatgtattcgccatgagtgatccggcttctacggcattagtttcgccgtggtgataccccaactcagcgacaccagatccaatatctgccatcttacggaatttcttacggtcgcctttactcttttgaagtgcgcactccataacaaagcgttgtactggtttaagaccatcgactaattgaggaatcccgcgttcctcggcagaatagatcgcatattccttagcttcattatgtacaatgctttcaaggctgcggtaagtaactgatttattcatcttcacctcatacacgcttacaaatcacattctttactttatcagatttatcagcccaatccaatagccattttaacggaaggattgaaacaataaacggggcagcaatcaaagcaaacatgatacacctgataatcaggaaaacgcaagtgacaaaactagcgatagtgatcccgacaaaacaaaataccatagaaaacagagtaatgatatagaaaggccagaatacccactcccgcatcttaacgcctttgtattctctgaattgcttaaaatctacaaacaactctcggatagacgcgtacaggacagaaaaatcatctttcattgctctgaatgagcaatcttctattttagaatgacctagcattattaaccgcctttaaccattgatacaggaattgttttctgatttgtgtataagtggcctacttcaattttttcttgaatcaccacgacgttacaatatccactgtctttaagttttctgataatgactcgcttttgttcgtcggtgataggattgactgttctcaccaattcaccgcaaataatagcaccatctttacaattaccagtaactttcatgctacgaccgtgaacaacaaccacgtcaccgtaaatcacattttcgtcgtcgtatttggtaataaccgtgaccgtcataatgtattccctctaagaaaggccgcgcaaagcggcctatgttgattattgttctacagtataaccgttgttttcaagccatgcaataacaatcttttcgccaatttcatcgagcatttcatcagcgccatattctttaatgaaagtcgatggatcattattgcttactacgtgctggatcacaacatgttcaggaattgcgtctagtagttcgctatgatcatactcattaacgatatcttcaacactaacattattaaccaaatcaacatcatccatagtcacagtaacgcgtcgagatggatataatacctgttctacttcaacatgtgcactttcgcaagtaaccttcatatcaatcataattaattcctctattagtaatggctaaaaccttcggttacatcttcaaccacatagtaacgatgacagcgcattttggcattcgcataatctttcgggatacttacaacgtgacgcggatcaactttgcatttaatgattcggcctcgcccaccgccatagtgcggaatatagtgtttcgctgcaacgtggaggccattagagcaagtgcgatcatcatctgggtccacgtctttacgcttcattttaaccgtgcgccctgggctattatcaaacgtatgcgtaaagaaatctttataatcaacatcaacacgtttccatgcatagaaacaaccatcttccccgatctcaatgtcgttgtgctctaagaagtcaaacagacgatctacggccttacggctagggtttttcttgcacttctcaaagaagttcagatagtgcgtatatggcttattctctttaatcgactccaccactcgacgagtcagattattatcaagaacaatattatgataatacacaataccattttcgatacggaaagcaccgtgataatatacttcaaccgctttcttaatgtcaatcagcgtaatagctttgatgaaatcattatgtttaatcgcttccagtgcttcattaaagttaacatgtgatgggtcagcagtataaacaatgtcaccacatgtaatagtaataaatttagatgaggctattgctacgatttttgaggaagtagtcacgggcttttttgcgcgttcaccgccttttcctttactggttttacggcgtgctttacggttttccagtgccttgcgaccttccgctactgcgtctttctgaatcagtaatacacgagaggcagtgcgacgagatacaccaaatgctgccgcaagtgcttcgcgggtagtaaacttaccttcgccccactgtttagccagtttgatttgttttgcggagtccagacattgaacgttacggtcagagacggtgatttttgctttagtcatattattcattcctctattagttgggcgactctcgccgcccgattcacatcattataccagaattattttgcttctacaaccttgcggattgtgcggtctgatacattatagattcgtgccagttcgcctttagtcaagccgcgagcgtattgtttacggatggtttctttctggatagcggtcagtttagtcatnnnanngnnnatnnnnnnnnnnnnnnnnagnnnnnnnnnnncnanactnnnnnnnannnnnnnnnnnnnnnnnnnnannnnnnnagnnnnnnannnnnnagnnnnnnnnnnnnnngnnnagnnnnnnnnannnnnnnnnnnnnannnnnnannnngnnnnannnnnnnnnnnnnnnnnnnnannnannnnnnnnannnnntncnanactnnnntantnnnnna

SEQ ID NO: 4 - DNA, 147204 bp, Unknown
  Bacteriophage genome sequence derived from the Myoviridae family
gtagatattaccaaattatttttcagtgtcaagccttaaagcaaaaatgctacatcttgcgcttttagtgtagtatcaaccattttcgggcttttataatcaacaaagcgcgcggttttttcaataacgaagccgagataatcttgtttattgaaattacattcttttttaaatgtttcccgtgccacggtgatcgctgcgtccagggataaacgcccatcaatattaatattagcgaaagatccgccaccgcgcataggtttaccagtgatgccagctacgatcattgatgcgctatatgatgccatgattatttctctcttctgttatgagcggcactattgccgccctatgtgatacatcttatcagattaaaaaacgttgtcaagaatatttttaaaagataataaccgctactacaatccaaaatggaacggctagaatgatagcgttaatcgttccaaccgtcaagctgttttctttcttgatcatcgttatcaaccttttataagtaatgttattgtgacggtggattatggagatcctcacctttgcccgtcctacattgcgccctccttttgtttattgtctgcctcgacaataaacaaaaggagggcgcaatgtaggacgggcaaaggtgaggatctccataatccaccgtcacaataacattacttataaaaggttgataacgatgatcaagaaagaaaacagcttgacggttggaacgattaacgctatcattctagccgttccattttggattgtagtagcggttattatcttttaaaaatattcttgacaacgttttttaatctgataagatgtatcacatagggcggcaatagtgccgctcataacagaagagagaaataatcatggcatcatatagcgcatcaatgatcgtagctggcatcactggtaaacctatgcgcggtggcggatctttcgctaatattaatattgatgggcgtttatccctggacgcagcgatcaccgtggcacgggaaacatttaaaaaagaatgtaatttcaataaacaagattatctcggcttcgttattgaaaaaaccgcgcgctttgttgattataaaagcccgaaaatggttgatactacactaaaagcgcaagatgtagcatttttgctttaaggcttgacactgaaaaataatttggtaatatctactacatagggcggggaaatggtttcccgccaaatcaaagaaagggtaacacaatgagcaagcaaatcaatactatcatgttaaacctggtatctttccgcgatgacgtgaaaaatctttcgcgtgatgcagtagatgcacggatcgaaagctatcgctcacagatcgcaacattaccgctaaaacgtgatcaacatgccgctaatatgatgcttaatgctatgcttaaaaagatgattcaatgtgatcttaccctggcttatgaatatgctggcgatctctttgtaacatacaataagcccgttccaggtatgagcacaaccgaagaattgcatgccttaaatctgcgacaagatgcatgggataatatgcgccgcgttatggtatgggtagaaagcggcaaaatttacgcataaaggctttacattacacgaaaacctgataagctatcttaaagcgggaatagttcccgctttcataggataaaactttatgaaacaatatgtaatgagtattcacaccaaaaacggcgctactgttacgactccggcacggtttgcacttgtaaaccgttgcaagagactaaaacgagagttaaaaaataaccgtgcaacgggctttaaacgctggggaggataatcttgttttttctaaaagtttttgataatgtgatcgcttttgaacatgctacaacgttcaacctggcgagatacgctatcaggtttaaagataatgtttatccccgtgctggaggcggttacactatttttaatcatcgtaacgctcaattaacggatataacgaatccagatcctggagtgtatcgcataggctggctaccgtcaaaagacgcggcaagcatgtttaaggtgtgtaaactactaacagaagaggcgaacgaacatggggcgtgaatatgtgatccagtcctgggtaaagcatgatgctgatgatccgcgcataataccagatgacatgatcgatcacatggtagggtatagcggggagcagataggaaatcgagcggcaaagagcaacggtcacacaaaaacgcgatccgttcgccctggttggctggcaaatggtaacgctgacattgcaagcgccgcagatccaagcgatgacgctaaaaataatcccttatacagcattgatccggcttttaaggtgttagaagagtatcccgctaaattagccgcactagataaggcatacgaagaaaagcgcatggcatggacggtatacaacaccgctaaaatggtgctagatgcaaaattgattaaagcccaggagaagatcaataaacttgttgcagtagcgcaagaggaagaccaggaggaagaggaagaaatcatgcctaccctggaagaggaagagatccagccatacatgccgacggaagaggaaaaaagacaagccctaaaaaattatgaaaattgcattgtgtaaggcttgacatatgcaaacaagccccgtaatatgtaccacataaagcggggcaacgcctcaaaggtgaaataaaaatcacttgacacctgaaatcagtaagctataatgcttatatagattgaaacattactaaggaataaaagcatggctattattgcaaaaactgagatcgtaggtttagattctatcatcctggcatatgaggaagctatagaaatgtatgtggtttcctatggtgattatatccgtgaatataaatctattgatctagcttttgaatgctatattcgccaggtcaataaagcatatgatgattatcgttaaaagttttagtcttgtgctattgacaacgaacgatagtacaagcataataacttttatcgggaatactcctaactaatcaaaagagattaaagactatggctaaaaatatcaatgtttctgcttatgctaccctggctaacactgctaaaattgaactatccagcattgaagcggtacatattagcgcccgtcgctggtttcaaaagtcttatggtaatacttatttctctttgatggttgacgttgagatcggcggtaaactgattgaagtcgttaacgttccgtttcaatatggttatggtgatcattttgataccgtcgccctggaagagtttagcaaggttatcaacctggaaggtaaagacttttcaaattatgcctacctttcccgcttttgccgtgataatgggatcgctgtatacagtcatgcaagcgatgtaaaacgtaaaaaagatttataaaaagcattgacagcacgaataaaaagcatataatacttatatcgagagcgggaatagttcccgcctcactgaaaaagagattaacatcatggctaaatctaaaatgtacaacggtcacaaaaataaaactcattggaatgtaagcctttggattaataatgatgaatcgttatacttatacgctgtaggtttaataaatgagtgcggcaataaagataaagcggcggatctgatgtgctacagattaaaacaggatggaatcactcatacacctgatggtttcaagtatagtaaaactgcaatccgtgccgctatggtaggaatgtaataaaagcagttgacaacgttttttaatctggtatagtttatcacatagggcgggaaatggtttcccgccaaatgaaagaaaggttatcattatggctatcgttattgttcgtgtatccggcacggttggaatctcccaggtagtagcagttatcaccgagaagaaaggggatgatcttcactcttccttgaatagctgggcggtcgctaacttcgggcaatggtcgagcgttgagtacatcgaatcctaccaggtgccaacgattagcctaaccgatctaaatgttgatcgcttgttgtgcctggatggattaaactaaaaataatcttgacaagataactaaaatcagtaaaatgtaatgcatcgggcggcaatagtgccgctcatagtaagagagattatcaagatggctaatatccgcacactgttaaaaaatgcaagtcaagttttattttcagatgacgagtatttcaacaaagacattacaggcgtgaaaaatttaaaagacgtgaaggatgttatcggtatccgtggatctttacgtaaaggtgacatatacggtaacaaggtgcaatataaactgtcaaaagattatgattttactttgacaattatttcataaaaccgcttgcaatactgcaaaaataaagtaaactatattcatcaaggcggtggaatagcccaccgcctaacaaagagaagaggaaacatcatgatcactttcgctacccgtgaagccgctcgcaacgttgcacgtaaagttaacgccgccaacctgggcgctacgcttaaagccccggtaaaagatgaatcaggaaaatggatcttccctggtctgcgtcacgctgataagctgggaacattaacgttaaaaaataaataatatccgcttgacagtagcatgatttataagtaaagtaacaacaacggcgggaaatggtttcccgccaacaataaagagataagattatgaaatcagtaaaagcaatcaaaacttacattgtatcggctatttcttttgaaggtactacaaccgaaaaagaaaaaatcaccgaactgatgcgccgttttaattctgaatactggtatcccgataatcaaaaacgttacaattataacgtgatcaaggcgatagcctcatggttacaaggtttaccgtcagacattaacatcgcctttgattataacgagattgatcatttattaattgaatggaagtacataaaagaaacaagcaaagaaacaaccgttacccgtgagcgggaaaattattggttatatattgcaagcatgatcgtaatcctggcaaaacagcataacgtggcgtaattaagaggaagaaacatgaacgcatcacagcagatcgaaaaattcaaccgcagcaaggcgcgtaaagattggaacgaagagatcaccaaaaaaggcgacaagcggaacaaaacaaagagagatcgcagcacaaaaagatactggaacgaataacaaaaaagggcgcaataagcgcccttttagcttatatagaggcttgttacccataggcaatggtaacgccaggataagcctataaatcaacgttagacggctttacaggagctttaaaaatgaaattagacgaaataagcaaggcactagcccaggggcaaaggttatgcgcccgatatcgtgatcaatatggcttcataactagcggcgtgatcctggggattgaaggcaataagatttttattgacacgttgaaaaacgttgtatatagtgacaatataatctcaataaaacatatatgaggcaagaaatgaaaaaattattgatcgctggtttaatctcttttggcatggttggaacatctagcgcggcgatatcctccacagtagcagaattaagcgccgttgatgcaatggaaaacgtcatgcttattaataatgcgatccccgatgaaatcatggaggattcacacatgatcgcttatggtgctgttacacaactaacggcaaaaatagataaatctattgttaatggcttaaatgaagatgtaccatgtgaaattattaccagtgtgctgactactcaaaattttacgccgtggttaaaaagtactcaaaaagtacacagtacagccgcagatcgtagcaatgaaaaactagtgtcagcccttgcaacgtataccctagcaaaatgcaccgagataaaagattgacaacatagaaagcacgttataagatacacacaacaaaggagaactacatgaacggcatagctaaaacgttttttcttttttctggtgtaaatgatccatcaataaaagtcgatagtgtaaaagaaaacaatactatcaccgctaaattgtttcaagatgaaacaaataacgtgctaatcattaatcttaaagaaataacgaaaggttattatactattgcttaccatgcaatctatcatgctggtactagtgaggaagtgcaaacaagcaataacgaaagcgcggcgctacctggtgatctggtgctgggcgttatcagtttaattgtcaatgattttttttaaggagtaaaaccatgccctatttacatttatttttcggtatcttattgacaggatcttttttcttctgtatgcttgtttctattgtaaaccacgttttaagacattaaggaaacagcatgaaaattattcccgtacaatatagcgtaataaatccagcatacgaggaaggaaggaaaacaagcatggctttatgttgtattgctactatagccatgttgttatacattgtgttttaataggttttatagttgtacgctttaaaggcttgacaatttttttgttatgctttaaactatatcttgaaaacggcaaaggccgcaaacaaaagggtaaaattatgaaatctgtgatcggtgtttatttggataactctgattttttctatcatcgcgctcgtttccttgatgcgattgaaatgatagaatcaggctttaaagagtatcgccttgcacatgatgacctggaagcattacagggcaatagtgtttttacattgcaagctaaagcactatgcaaaagccggatcgacattgcgagcaaaaagatagaacgcggcatgtcctggttgcgcaccgcagaaatcaacatggggcaatggtacggcgaaaacttagaaaataaacatacttttgtcaatgtagaaaatattgaagattattgattgacagcacacctaacgggtagtatattgtatctcatagagcggggaaatggtttccccgccttaaaagaagagataagctatgaagatcacaaaagcactttccaactatgcagcacgtcgcggattatgtttaaccgttgaaaatttagggaaagaagattttttgtgcttttgggagcttgagaatgataatgagtggatcttctcttattctatctgggaagatcaaaacggttgtttattaacctggcgcggtaatatctatttaccggaagaaatcaaagaagaattaccaggcacgatcatgactgagaaacagcttaaggaagtgatcaattttgtagggcaaaacattaaaaaataatttgacactaggcaaacaacgtagtaaagtttatcacatagggcggcaatagtgccgctcataacagaagagaaacaaatcatgatcccaactatgttttatgtatcgcgcaaaggtcacaatattttttggtctgaagatttaaatgaagccatgacgtttgcccgtgatcgtgttgctatcggtggcgttaacattactgtaaccgatgaaaacggcattgaatactataacggcgacgatgaagagtaattaacaaggcggggagtattccccgccgtcaataaagagataaatcatgaaaatatcattggacgttgcaatcaaggccatcgaatccggttacaccctggtaaaagatgataaggctaaaaccgtgcaccacgttaacaaggaaacaggcgaaagcatgatcacatataaagccgcctactttctccaatcagtagcagatccgcgcgtacaacgccaggttacggcggctattgctaaaaaattatgtgctttacagggtacaagttttaacgagatcgccccgtgttttgactggtcgagcttgaaaaaatagtttgacaacaattataaatcgggtagaatgtatttcgtagggcggcaatagtgccgctcataactaaaagagaaatcagcatggcgcttaaaaaactaacaagcaatactcgttgggatgaaatcgacggagaagtttacattttcgcccgtaaaccaggtgatcaaaaatggtcaaaggcttttacttgccaccctgcaacaatagatctgataaaaaggaaaggtttacgtgaagcagtagcgagaagtttactgatcccttataaaaaatagtttgacaatacgcggttatctggtaaagtgtacgacatagggcggggcaataaggcaacgcccattaatgagggtagaatcatgttagagaaaattttcacggttgtagtagttggcctggcgttatcggttggattggttgcaactatggctaacatgatcctatcttcccacggtattggataaggtgaatcaaatgatcacgaataagacaggtaaaacagaatttttacgcggcttgcaaataggtaaacctgagatcgcattgcactaaatccgcgcataatgaaatgaaagattttaccgctactttacaacgtgttaaaatatctatcacgcagaaaaaagccttgctagtagtagaaaacgagataccgcaaaccattattattgtcgagcgtacagcatgaaaactgaaatttattgaaatcatcaacggttataaagaagcctttatttttggaatcagcaagggatcatgaaggtaattttatagatgacatgactgattatgatttttcagatcaagcccatcaacggatcattcatgacgtagcggcttattgtgatgccaatgactgctatctctgaggcaatgagcgggcgcaacagcaaaccagatcgggaatgacttacatttcacccgtaacggtcacggcgtaggcttttgggatcgccctgaaatatacactactaacaccgccaaccgcctaacaaatgcagctaaattaatgccatcggtgcatgcttacattggtgaagataatttgatttatattgaataaaagtattgacaccgatccccaatatggtattatttaccacgtaggcgggaaatggtttcccgccaggtaatcaaaaaggtaaatactatgcgcaacctggtttctgtttctaacgttgaaaaatttcaatctttacagggtatcgttaacaacgtagcgccttttttagtcaacggcttgattgcaaagatgaaaaataaacatcatgccgcatggtctgcttactgctttgataatgatgaaaaagcggctgaaatgatgttaaatatgctgttagacagtgtagaatcatctttaccggaaaacatcgcagaagagatcacctatcgttataatatggcgatcacttaccaggaggttgcgcaatttaatatgatggacgatgacgaacaacaggatcaggaaatgttctgggagtatgcagatcgtcaatcggcttttgatgaaaagttagcgatgtattataacgaatattaatacacggtaaaagaaaggggcgcactaagcgcccttttttgtattcttttttcacgatggaagtaacacgtaaagaataaacgtaaaaggtggcgtaaaacagcctaaaaccgattataaccgcttaaacaaggtaataatgactaatcaccttgccaggatgaaaaagctgttataaagctgtttagagcgtttaaagcacataggaaataatttgctttttatcttgccttttatcctgcttttgattattattatggaacgggcggcacctggggacaggggaagataatcaccggaagatcttatcatatattgatagctaacatctatcaaacaacaaaacatcaaaggaataaactatcaaatctttacaattctacctattgacaccggatcacgcttacactattatttatcacgtagggcaaatcattttaaacggtaaacgaggaatcaccatgagcaatatcatcaacctggcagcgactgtaaacggtaaagactttaacggcgctgtagaccgtgatcctatgtggtgcttatcagtgtttaaaggcgatctggttgaagttagaacaaccgaaggttatagcgacgattataaatgcgagattcatttacataactggtacacgggtaaaacttatgcgctgaatcatgcgtttatcggcaaggttgaatatagagaaatgatcgacgaagaaacggggcaagattttagcgagcatgtttatattcgttcagaaacattagccgaacgtttgatcgagaaaatgaaagcaaaaaataaaattaatttagctcattggattgatataacaaacgattctgcttatcagtaaataacatttcataccagggcgcacaaagcgccctttctttttacctaaataaagatgatagcttttacctatcaaaaacgttcaccgaaaaaagtgaatagatcgcggtatcgagctaatcaaggagcagatgaacaaccataccatgaagatcataaggcgcttacaacgtgttttagaccgcttatttttaatttctcaatgtaactatctggcaaaaacagcctttttcttgtctttcctcttaaatgataatcattcttatttatagctgattatttatgcaataaactgaataatgcaataatgataatcattcttaacttatgaccatctaacctataaaataataagttatctaactaaattaaaactaattatctcacctttatttataacttactgttactatctcattgataaccttatattaaacaacaataaccaatataaatcattactaagctaaatataatctatctaacctttaaaactataactataatctatcgaattgttgcacaaagtaactattaaattgttagtaacattactaaataattaatatcctatctatttatgatctaatctttaccttcctatctattacctaaataatcatttcatacagtaatcatttcatacaataattataacaagaaatataattcgcaagcgtatcattagcagcctatgccggacacataggcggctaataataacgcaactacacaccccacataataaccatcaccgatagttattatttgtgcttatgtagcttgcaacaattgcaagcgcaacaatatacatggtatattgtatcccttacattgttgcggtgcgttattattagctaatgtttagaacattggctataatataagctacataataagctatgcaataataaacatggtgaataatgacattgatgatcataatgcgccaccctccagggggcgctatgtgaacacaaagaaatctttcttgtcaagaaaaatattaccactattgcgcaaaattatttataactgaatagatgatttttcatactattattgttatttgtcgggcataactatccctatttgttgagcctactttcttaaaagcgtaataaatcagaattatcttgatttttagggcgttttatagtacagaaagtatgcaaatgataatcattatcagctatcttccacgggtggcactatttcacgccagatcatttcatttggcaaggtgtatatagatgtttagaaatgccaagccattgatttacttagaatttatctgttttgttgtgagtagtgcctttcttgctcagaaaataatcaaaagtcttataagtcattgaatgataatgcaaatgataattattctcattgatatttgagggggacggtcggcagaaatcggggggcgctgaaaatcgcgttaagcacctctcgcaagcgagcagtattttgcggcaagttattgatattattgactttacgcttatgaaaagggggtgtgtcgaaataaatcgggtataccggaaaaattttgtggcatagatatttatttgtctatattatgtacaaaggggtgtgttaaaaataataggtatatatagaataattgatagggaaatcctatactaatccctatactaattcctccattaatgatgttcctatgttgctgttcttgtaatagatgaaaagatgctatatgatgtgtggcatgagacgtaaatttataagatgcaaataatgcttgcattgaatagaaatgcctgtacacttgttccataaaatatgcaatatcgcgcataaccaaactactaatgagaggtgtaaatgaaaactgtatctttgtatcttgctaacacggagcgtgtacataatctagtaaaagaatggggtgttagtgttcactttgaaatttgtgaacgctatgaaactattcttagttctgtagaagatccagataccagtgaaacaggtgtttcccacttactgtggatgttgaatgaaattcaagaaatgcgagatgtacaacaggattatgaattctacccagaaatttgtgaacgctatgaaactattcttagttctgtagaagatccagatactagtgaaacaggtgcttcccacttactgtggatgttgaatgaaattcaggatgggtgtaatgatatgtctgaaaccaaacgccatcgttggctaggctatattcagggtgttatggttatgaaaaaccttattacagttgatgatgaacgtaatgctacacgccccgtctttaatggagcataacatgaaaagcattcaggtgtgtattgaaaataattgtggctatctggggttgacacatgttgctttccctcttatgttagatgccgatatcgcttacagcggagttgcttatgtgtcattcaagacaatgagccaagtacctggctggaagtgggaagtagttgatgttgttgaaggagaagactatgttttccttccacacgaatatactgtttaaagagaggaaaagaagatggataaacaaactactgtgtacttagtaacaaagaataccccaggctggagccaatgcagcactgtaccttacaagatctgtgcaacattagaactagcacaacgtgcagaagcagaagtgaatgccatgcaatacagctatggtgaaatcattccgtttacccttgaacaataaggagttgtgtaatgtttgaaattggtaaagtgtatcgttttaaaaacccatcttatatccgtaagtttgctaacgtgtctgagtgcaatagcaggattgcttcttttttaggtgattcctattttcgtgtattagatgtggatgattggtatggtgtcactgctttgcaatccttggcaggagaacaagaaattatcgctcaaaatgaaggagactttcttcagtgttacacgttgcttgcaaaaagtgagtttgagtattttgtagaagtcttagaggaagcaccaaaaagtaaacacgaagagaaatacctgcttgtagtggatggagttccgatcatggaaaccatctcccgtgaggaagttgaaaaagaggcgaaacgttacaagctggatcgtacacagagtgtagttgaaatctattctcttgttggtgttgcagatattagtgtgaacatcgtataatatatgtgtaatgacagatacattctccgtgtatctgataagtctcctatgtttgactggcggggctggtggctactagctccgatgcaaggtctgacagacgtggaaaaggaggcttatgtgtatacaaaagaagagatagaagatagcctttatttgacagataacattaagaatggtatctttgagtgtaaattgaaaggagaggaagaatgactattacagaaaaactgcgctgtattgcaaagcaaagtggagaaggtttatggtttcctattgaggaaattattcaggactgttatgatcaggctaagactggcaaatactccaaagcatttaaaccgtctgttttcggtttggatgactatccaaaaaatgaacaagcaaagaaacgacaagttgatttgattgatcttgctatggaagcactacgagagcatgggcttagtaaggtgtatgctttaaacaccaaagagggctttgtagattcagtgatcgtagactggtattaaggagaagccatgcaagaaaataataaagtgtgtaacatgaaaagcagcccctatttgctacaattttatgagtggtggttagaacaagaagatacaaactttagcaaaaagcattatggtctttgcacgtgtcttgtagacttcttatacaatattgcttggataaaagatgttgagaatgtagcaaacctccagtcctctgtacgagaggaaatgaaggaacagtttaagaaagcaggtttgaaccatttacacccatttaatacagatttctcacattactttacggaaacagagttaggcattgcacaccttaacaaagaacgtgtacaatgggtgattgatcgtattcgtgatatggaggaatataatggttaagtttaaaactttctgtgcaatctctgtttgtcttattcttgcatacgtgttattctctagtatcattcgtttaggtgagtatatggcaagagaagctcgtgaaagtgaagctaaaaaagaacagtgcatcgtgttaaagcaccaaagggatgctgaaaaatttcttgaacaggattgtgggcgctatgtgaattataattaggagggaagtatgttagatatttttacctttgatcgtgttggtacaccgattaccgaagaagaacgtaccaaaattgaacaagaattggatgctttacgtgcgtctcttacagacacagcctcactacaacgtgaagctgcacatctcacagagatcactggtattcagtggagcacggagtgggttgtaattacaattgaagcggatatttggggacatgaagagacgctacgtaccggagtagtaacggtttggtgatagatgttattcttttgtgtttcttgatatataaataggagggtttatggtaaaacgtctggaatgggatgcgtgtactgctcacgcttgtcactgtgatattgtggaagatcctaatggagaaatggtgtattatgaggattacgaagcattgcataatgctgtgatcgctttactggatgatattagctcacgctatccaggacaacagtttacgtgtccacatatccaactattagccaaacttacggagtatccaagtgtttcataatatgggtgtccctgaacaactcctctttattgtaggattagtgggcttattagcggctggagccaaagccgcttctcacacgcatcacataatgttaagatttctgttcctactcccttctatccttgtattattagtcatattgattgataacatttttcacaattaaggagaggttatgagtaaaattataccaagcagttatgaattattgcagttttatgtatattacttagactgggttaatagatcgaatgttaaagacaatgcgatgtttagtaaaaacatctgtttaacagaaagtatcttccgttattggcacacaggcagaaagtgtacacacagtgaagctatgcgtattgtaggtgaatacctggagcaattgcaaaaagcagaacttcctgtccttcacccattcaacgaatctaaagaagaattagaacaagagtgtagagaaggtaagtgccatttaaatgaaaaacgtatcgaatgggtgaggcaacgtttagccgatgcaggaaagactcctagtgactctgactatacgtggtatgatgtagagggtttagttcaaggttttgaggcttgtgctatagataataccaactttgccaaagttttatgtgaggcttatgatctggcagataaaatccgaaatcacggatggaaacaagagcataaagaatcatatgaacgccttgacaagattttcaaacagatctattctaaccacaagaagatgttccaaatggaggatgtgtaatgaaagagattatgtttgaagggcattgttacgaagttccagacaatgcaaatttcatggctcgtgatatcactggagatgtgttctggtttgaagatgaacctatgttttcttcgaacaaacactggttttcacaacaatcttcttcggaaaatatgacttttggctacgtagagcctaaagtacgttgcaaagcagcttcttctttggtaaaaatttcccaagatgaccaagaaaatactcaagatgttgttagtgcgctactgaagtacattgcagaacttgagaagaaaattaaagaagcagaaactaaggtgaaagcacgatcagcaatcatcgaaactatgtctgaacgtattttagaactagaagatttgtgtggagaggcttatcaagtggttggtgcgctggcgtgtgaagcacaaatgtttgaaacttcagaacaagtttcgcatatgttagataatttgagtgaatgtaaaatgattcatgatgatgtattgccattttgttgcaatgttaacaaaacagagcaaacacaagattcagaaacagtttatgttccgctaatgtgtgttccagatcatctaaaaggtgtattctcttgtaaatggtcgctgttgagcgttactaattgtggtgaaaactattctgccaacattgaattgctaaaacacgttaaataaggagagtaatatgtggtctgttaaaatcaaatataatgcgcagtattatggtggaaagccttacgaagttgttatttgtgattgtatctctaaagaagttgcacagctttgtggcgctggtgttagtgaatctatgaacaaaatgcataactctactgtgcgttacttggatcaagatattccagaagatgtaaatgactatgcttacgaagttatttacagtgaaggtaagaagctctctattgaagatgcacttaaagcactacctgctatgtgcagcccaacaccaaaagcagttaaagagattttaccagaatccaaccccgatgaatatgctgctatggttgcttcggacatgtggaatctctgtcgagaaactatgattaaaaatctggtggaaatggcgcatgagtaaaacgcactttatacatccgtttgatccaaagaacaaggcggttatacaccgccgttggactgaaacgcgcattacaaaatgtcctgtgccagcagcacaggaatataacaaaacatataaagcagaatttgtggagtacacctttgtaaataacaaagggaaggaggtttatgttccagaatactgcctttggataaaatgggaggaataatgcaaacattttttatcgacaagttcaataaaagtatgaacacgtggatggcaacattcactatgcaatttgcgtcatttaaagaagctcaagaatggtgcgatcaacacaaggattttgatttttactatcaagttaatgcaaatctttctccagaggagaaataatatgttggctgatattgaaatccttatgtaccgacaaggtatgatcaaaatgtggctagattcttttagcaacatatactgcacagtacgatcagcagacgagcgtaaaacgcttattttatctgctattgttgataaacaacgtttcttcaaagaaattttgcaaacaggcttctccgatgcaggagtagagattgcaacgcttagtcttggagtgctgtcttacttggaatccgttgttttatatgtcttctctttagaagaacacttgcaatttgaagcattaaaacttatcttagatgctgcaattgacatagaacaaaatcgaattgattcttttgaataaaaataaggaggaaactatgcaagaggttaaacattatccacatggtcgtagttttgtagctgtatggcatgttcctgctcgtaatgaactattttgcgcatcttttcattacaaagatggacaatatttcacctatgacgagacgatggatgatttcatcccagagtgcgatcatgggtatacaccaatgttctttaaacgtatgaaagctcgtttcttcgttacagatgttgatggtgaacctacttggcacatcgaagaagattggcaagattctgtggatattaaagaagccccagaatgggctacattactggtacacgtcaaaacccctactcttgacgttatggcgtgggttaatcatgatgatacccattaccaatacataaatggtagcacagagatttctggtgagattattggtcgttggaagcctacgaatcaggttgctattgtcgggtataagacagtataatatgaaaaatagtgtagattgggatgatttatccgattttgaaaaatggttcttaggtagtggttgttatgcagatggggatctcgaaagagatccttctggaaactacactatgccattaacccaaggtttttatgagtgctggtgcgcagcacaaaacaacgtactgaataaggagacaacacaatgcaattaaacatcggacaaccaatttttgatgcagatactggtcaatatgcagtgattgttgctcgtatgagcggtgatgaccttattgtttcagaactactcggatcagatccgcaactgcgcgtagtatgtgacctatatcttcgagacgaaagtgatcgcattgcactgaaagaagatggtatgctctactatacctggactagagatcctggggtaacggaggtagaggtataatggtaaggaataggggtttacataaaagaagacaccttacttactggcatcgtaaagtacatgaacctgtatcaaagaaagaatggcaatatctgccttatgggaaggagcgaagaaagtacctgttagctcacttaagggtacatggttctcttcctgttaacagtaagtggcaattgcaaacagcttatgacgaagatatgaaatatctgttaaagagaggcattatttgccttgttaagataggacgatggaaatctcgtcaatcttatatcgtacttaaacaggagaaacgatgaatatcaaagatgttgtagcatacgtagaagatgaagttaaaaaccatacaagtttactgaaagtaatggttgtggttaaagatggtattggacaagtaaacgtacaacatgtcttatctgacactgtatataatgtgtttgaatgtaaagaaacacctcatggagtacgtgtggtttatattgataacaatttcaaagaatgtgtgagacataccttagaaaatgaactaaggatcacaatcttatgagttattatgttgtaccttatgccaataagtggagagtaagagaaacttgttttctattctcctggtgggctacgttcggagatggttgtggaaatgatacagggaagcctgtagagtacgacacaaaaaagaatgtgaacagtggataaaattaacacaaagatgttgacacgatcttaacttcttgttagtatcaatgtgtactaacgataaggagggtttatgaagtctgtaaacaagttgcaacaatttttgttatcaacagcaatctttttgcttttgttaattggtattctgtatggtgcatctaacttatacaatctacataatgatgtagaacagaataaagagaagtgcatcattctaaaacacaagaaacaagcagaagatttcttaaagaataagtgttacaactacattgattatgaggagacaaacaatgattaaagaattaggtatgcgagtatacagtgagtggactccaagcaatggcccaggagttgttgcagctaaatgtatcaatggtcgtattgagtacctggaagggtatgaagataatgaagagttagtagattatgctaaatcttttattgaagatgatacagactttattgtattatatgatacaggagagttagagtatgggtatgatggagatggggatatctttgaacttcaataagagtagtaagtaaggtataaagagtatatagttagttatagagttagtaacattacatatactctttccatgtataacatggaatattctctacctcgctatcgctcggtatataagattagggtagcatgttttttacgaaaagtaaaactgtttataccgattgatagcaggtttttaatagattctatctatgaggagtagaaagtgtacaaattatataaaggaaaagataagtttacgggtaatacatctggtttctatgtaacaccacgtggcgttgccgtatttgattggattcctggtactccagatcgtgaaatgatctctcttgtaaaactgtcggaacaagagtacacttacggtgacattacaacattctattctcgtgcagaaaatccaaaactgattgcggagtgggaataatggttacacgatatgatttagaggtgtacagccaaggtgctgctggtcaatgtgatattgtaccagatccagaaggagactatgttcttcttgctgattacaacaagctagaagaaagacttctggctgtgtatgctaaagagaacaaaacaatctgtccttattgcaatggaatgggttgggtagttgcagatgttggacagatgtatgaatgtgtgccttgtaaaaccacaggatttattgaaaaggatactgacaaatgactgtagcagataaaatgagagaactggcagaaaacgcagaacttaacaaagcaaaggagagtttacaaaatatctacgcgtatattgaaagagcagctaaagatggagacagagaagctgctatatacacgctttatccaactttcgtaaaagttagcttggatgctgaaggtttttcaacttttattgatacagaaacatctcattacgatgaaaactttactcgaatagttattcgatggtaaatttctgatatttatgcgccctggctacctgggcgtaataaattcagcttatatttgatccgcgccttcggcgcttaggcaaagccacgccacacaggagagtttatgttcaaatggttaaaagagtttctaacatctttggtagaacctaagcaagacgttattaaaagctctatcacaggaaaaccgcttgttatagttacaggcggctttggtcatgggttttctcttaaacaaacagatataggtttacagggatctttgattagttttagaatcactcaattaggagataatagacaaacaatcttagaccttttcaatggggaatttgatgactatttatccaagagtggtaaagaacgtctgatcgagcatataaaacaccgctatgagcatggtggttactacttagatacaaaacgtaatgcacaaggtgatcttgacatagttcgtatagcgtgggataatgaatttaaaactaaacttggtaaacttctggaggagttatggtaaatattaaaacaggtgatattgtacgtcttgctagtgaagaaatgttaatgactgtaatggtatctacctacgatacttgcgaagtggtatggtttgatgttaatgaacaactacagaaagctacatttgataaacgtatgcttcgtaaagttgaagaagtgaaggaggaagaataatatgacaatgttgcttcgtatgtttgtgtttcttatgttctggattatcgttggtaacggtattgtgtttttgatttttcctgaagtaatgacaggtaatgaaaataaggcagtgccttacattatgcttatcggttacggtattggtacactcggattactgtttgctgactggttagtcaatactttgttctctaagtacaggaacaactaatatgtcggaaaaattacctaatgttttcttttgttttgtagattgtgttacacaagaaattatagttgacgaagaaggtatgtttacttattttgcatctgaagaagaggcaaaactgtcagctatgaaatgtataagccaattgtcagtacctgctgtcaacaggttcggtattgcacaggtgtataaaacagtaacagagtttacaccagatcgaaaactaacttttcttaacgttcactttgtttgtaagtttagtgaactacgacattaaatcaggagtgaaaatgaaagaatattggagtggtgagaagggcttactaaagccaggaatgcttttgcgagtgaagaacatgttgatcacacaagattacataatgcctaatcctggagcattagtagaattccttactgcgcgagatcaacctggggttggtgaaatgtggattgtaacgtggatatctctcgatggtaaattgcgcgttgctcctattgacccaaaacacctagaatctccttacgccagtattgatcctcggatcatagatttggctagagtttataaagctcgtactggtgtagaattaaatgtggaaattttaaatcaatgtattgacttcttaccggaaaaagtgcataatgcacaacaagaaggtaacggtttagaagttgttcttcttaatgatgggatgttctctggtttggcatccgtagattttccaataacattaagattgttacctggagaatatgtactggatgaagatactattgctatatcctctaaaattttagaactcattccaggtgcaaggtgtgttggtgatacatcttccttgctgtttactctgaatgaagaagccattatagttaaaaaggagaagtaaatgatgacgtttattgttggtgttgttgttggttattttggtcacaagtaccaagatgttatcatcgctaaagttgacgaagtaatcgaaaaatttaaacactaatttttaaaaggctgtactgctgtgcagcctatctttcaaaggagagtaaaatgttcaaagataccaattataaatgtgtacattgtggtaaatcttttggtgatcacaaagctaaaacattcaattgtccacgaaaagggcgaggtagctttaaaggttttaatccatcccacgtttattctcccaactacgagaaaccagaagaagaaaaatttgtaatctgaggaggcaatatggaactagtgcaagaagtttatgaaaaactgaaagaagagaatcttgattggcctgaacatgctcttattgtcgtcaaagatactaatggtgaaataaaattctcaagtgtaagtgaagatgatgttgttttaagtcctacaggatattatatgagaggtgttacgtgtctattcaacaccaaagtgtatcctgaaattaaacttagttacggtgaacctgatcatccagaaatcgttacacgtaatgaatatgaaaattattattttgctcgtgaaagcaaataaggaaaactatgcaaaaaataaacactggttctcgtcctaaacagaagcaaacaaaagcaagggtatcttatgttgacaactcttgttataatttcaaaaatgttaaagaagttatcattgatgaaaaagaaggtttgattcacatttcatctgaacgtttgaaaggtagtgttactcttcgtgagaatgtatctatacctatgaaagttgtggctacactctgtgttgataaaccagatgttgttaactactatgtgttccgtgatagttgtatttcattacataataagatttttaaatcttcgcacgttaaaacaaaacacattgtataacacataaacccgcttcggcgggttttcttgtatgtgtgtttttatttgtcttagcataaacaataggaggtattatgtctgtagttgtagaaggtagtattggtttcttagtagataaccctcaccctttcgtggttaaggttcatattcaagaaaaggtaagcaacaatacgtggttgtgcttgttagatagtaagatacactcttatacagaggtttatcttcatacttggcaaattggtacgataacagcagaggatgaattgataattgaattatatgaacgagatctatagatgactttactagagagtatcgtagtgttaatcatctttatcattgttgtcataggatattttacagaagactaaaataaagcccctagaatcacttctaggggcttttgtttgcattagatagggaaacgtattactaaaataaaaagtgcgttagaatgcgttacaggaggttttaggaatgcataaaatcttcttcagggcaggttgagagataagagatgcacgttgggacaacaacaacattatctttaaggtttgcaaccaagccttttgtaattccagccactgctccgttaatatctgcttgacggataccaaaaccttgttgtgcggatagataacaaaatccctcacctttctgttgattattattgaagtaataaacgtagtgcatcataaaatggtctttaacgatttgttctgtggtcataatattctcctataagaaaaggggctttcgccccttggtcaagttacttagtcaaatgatcttctatcatttttatgaaagcaggattgctaaaagcatctgctgccttttctctataaacaaagactcctctatcttcgtaaagaagagtttcttcgtaattaattcctgggttaacaacaatcatttttgtacccatagtaagtgcagggaataattcccaattaaaattgataacttggtttgaacatcctactacaacaaccaaatcttgcatggtcaaagtatcaaacaagtgagccatatctgcatacaaaggtgcagcctcaccaaaaaatacaacattaggcttcacccagttataatcatctatgtttatactattgtaaccaatatctaccagtgtcttgtaatctccagggtgcatacggtaaactacttcaggaagatacccgtgcacgtgaataacagaatccctgtccacacctgctcgctctagtagatcatcgacgtttgttgtcaagtttactacttggttaggatattccttaaaccactttgctatttgaatatgtgcagcattaggttgtacatctttaagctcaacacgtcttttgttataaaattcgtgtgttttggcatataagtccataccgttctcgtctacaccaccgaccactggaagatctggagatgttctcacacgataacctgcttggaaagctccaatatcgcagacctcttctaagtcatattcttcccataaggcacgaccactatctgtgtctgttcggaacgttcgaatcccactgtctgcacttaaacctgcgccactaacaaaaattactcttcgcattcaatatcctcttagtaatcatcatcccaagaagatgcgtcgtaacgctcttcctcttcgaaatcccaattaatttctactccaaaatctaaaaacaatttaacaatgttttctgtagagtagtatttatcataagcattagctagttcccaatacttgtcactcaattttttatatttaggatcattatagtcataatctactttataaccataatcatacatctcttgttcagctttaagcatagcttctggtgtaagaagattagggaacggacgatttctttcttttaacttagaagcaatccagtttgcaacattcgccacttcaccatctcgattatcacctaaacaacttgcataatctccatcttcgtaagtgcctaaatccccactaacttcatgtacaatagacgaatacgatccacacgtttcacaatctgaaaaagtgtctactgttgtaatatcaatagataaaactggtaaagccatagcttctttcacacaagcctcctcatataataacatgtcatcaaaacccatatatcctccagacaaataaagcccctgcttggggctttggttaagttttacggattataccagacttttaaggtacttgtcaagggcttcttgatcaccttgacaaacatagcaacggaagtcttgagcagaaggttctttgtcctcgtcccaatcccaatagacagtacctttatagcgtgagcctgggaactcgaagtatgccacatgagtaatatggtgtgggccaccccaaaattctgtaaaagtaaattgaggatacgctgctttaactgtattctcaaaccaagttttacgatctaatgcttcgtttataaaataagcatggcgttccatttcatcccaatctttccaaacgcatttttcatccagagaaaaaacaaaatcttcactgttaaaatcgtctgtatctgattccaaaatatcataatcatgtgcactaggtatccaccatccagcttctaatagtgctttcacgggtacaaaacctttttcagcatattgatcaaattcttttactctacgtaccagtgcagtattcatcttcaccaccaatatccagtagacaagcacctttgcgtcttgctgcaagaccatgtgtatcaaaaactacaacactaccttcaccgtcttcacgatctacttgatatgcaactttttgagtcatattacccccaatgtatatgggaaattaaccaaaagataaattcccaaaaacaccaaccaagaaaagttaatggaattataaaggctatcagagcagtcttccagcctttccacaatgtttccactattcctccatacatttaagaatatgtgcaatgacaggtatagtccaaccgttacctaacatcttatatgcttgtgtgttactactcactttaaagtaatcatctggcacaccttgcaagcggcaacactctttaaccgttaactttctataatgtacgccttcactcaatttttcaaaggcatctagatatcttccaggtggaatgtaggctaatagtacgtctttaggcacagtcgtgaggcaacgagttttttcactgtcctgaacttccaaacaatgtaccaaacgatcagttttagatgtactacgtttgccattttcattaattctacgcccatatattgctgccggataaaaaaccagttgtctgcgactcttttcaaaatactgttctatattaccacctttggcataatttgcatctatgcaataagccttatctctgtctacaatactatcatcttcaatgatatcttgcaacacttcattggtaatctcccagggttttatttcccagttgcaccagtataaacgttgtctattctgtgccgtgaaatctgcggagttaatgaatacgggatcaacacctaagtaacttgtgatcacgttttcccactccactttcatcttaacgttttcaagcatgaacttaacattaggattaaactttttaatatgttcaagaatttcaacatattcgaagaatagcttagatcgcggatcttgaaagttcaaacccttaccagaagaagagaagccttgacacggactaccacctaacaaaagatcaatttctccccacgggatatcccattctctccattttgtaacatcacctaactgaataatatctggaaaatttgcttggctttcagctacggcaaatttgtctaattctgaagcgtaatatgtatctacttcaatacctgcactttttagcgcaagcattcctcctgacataccatcaaaaagacttaaaactttcattattacttcttctccttaacactagctggtaattctgccttgaggcagaagtttaaacggtaagcctcattctcatttaaaagtacagattcacacgataaccagaacaagagatcctcaataccaggactgttaagccaacagtgcagaagagaatgttgttctatatcaatgtaatttagtaacaaggcttgtaaggcgtaactagttcctgtcgtttttgctttttcaaggatgatattgtgtttactaacaactttcttcctaagaccaaaccatttattaacaacaacagtctcttcttgtagttgttttcttattttctcacattctttaactacaatctgcatcttatccactgctgattgaagttgttcttttgttgggtttacaaaataatcactataatacatgctaaactcctcttctgtttttctgtagtctattcgaaaaaactggtgttgtcaacaaaaaacccgccgaagcgggtttatattattctacaggaacttcttcaccaagagaaacttctaaacggaatgctttactttcaatacattcactaccttttaagaaatcgaattgcactatagactgacttaatagaatagatagaatcacatcgcaatcttcactaggagctagatgtttgtattcttccttcaaggtaacatcataaaaacataagtcccctactcctagttcatcccatccttcccatgcatctacaaagttaaactctaaacctttcatacaacctcctcgtagttgttattgtgttttactgtctcaacatacaataaagattccatctgtaatacattaccagaaataataaacccataagccatttcagatgtgtctatatcatatgccccgtcttccggtttagcaaagtgtaaaactatttcatctgggttttcttcatcccatagtttagaaattttccgaaccagaatgttagctaaaatagttgacattcgggataaagctgtatcctcatatcttttaaaacctagccaatagaggttaagaatttctacttcttcttgtgttaagtttttgtctaaagtaatcagatctgtagagcacggcgtttttgttgaacctactgttacaaaacctggagtgttatgaaaaacaatcttaactttatcacgtataaagtttaaaccttgtgcctcaactatatattgtattgtaggtacaatatcgtttgttacatcaataaaactatctttaatgacgcttatattatttctggacaagaccattctcctctaaaataggcttaataaattcgaaaatttgttttttacttttacctcgaatattaaaacaagggacattaaactttttagccaacatccaagctgttcttgtaccacctaaaggatctccatttttatctgtatttgcacaagctaaaagaaaacaagatggttttggattctcaagatctcttccaagaacttggtggatatttctttgatgtaattttttagcaccttgagataatctgtcccaagctggatgcaattcttttgcatattgcaaggttagagcatagtttacactatctggtctgtcaagaacaataacctctccctctatttcattacctttaaacgagagccaagggatgtatatttctttctttgtattgttcccactatcatataccccgcattcaaatgcggaatctgcaccttctgctttaccagatcgcaaaatgaaccatgtagataaccattttgcaacagataccatagtatcccattcttcgtctgtaatatctctgctaccaacacctgtgtagaataaatcgctcatggttttctccttaacaagtaatattgggagtaacaattggattaacaattggagtaatagggtacgtaaaccaagggcttccaatttcccaaggattataaggtctacgaggatcaaatggaggagttacttcaggctttttccaaatctccgctagttgtttcttccatttatcccttgctgtctcattatcttcatccaactgttcatcattatcttttatttctggttttgtaaataaaagctctttgactaactcaacatcttccgtctcaatagtagtttctttcgtaagttctcctactgtttctttaattgtgattttatacattagtcctcctctaaagtagaataaaattgtaacgtatttgaatcatcaaaatatgcaaaggttaaattaccattgaagcaagatcctgtgtccatatataccctattactgctaatcacaggtttaggaacataagaatgcccgtgaaatacataatctactcctgaaaccctaggaagaagaattccttcaagtgcgcaatctatcatatcacgatcccacattaaagattctgtgaatcgagaaacttgctctttattcatattcaaacaaaatggcaaaacttctgtcactggtaaatgttccaaaactgaaggatacccaccgtgaataaagcctagtttcatatcacgataattgacaacaagtacaacaggtaaatcttctagcatcaaagcaagagcagttgcaccctcttctccacactcgtctagaactgtatggcctccgttctgaaaccaacattcgtaatatcgtctatcaccttctagcaaccctttaatcatcatatcttcatgatttccacgaataccataacgatttagctttctggtgaattcaacaacacaacgaaaattctgcttgccgcgatctgtaagatctcctaaagatacaacaacatcttgatctcggatacctaaagtattaacacctttctggtacaaatcaaagcaaccatgtaaatcaccaataataaacaggtcttgatcatcttttacactaatttcttgatatactagcatcaactctcctcaaaatccataagtataaagatattaactttaccttctatattatgttctacaacaagatctgcaaattctttgtaggctttttcttctatttgttcaatgtgagacgctacatctttgtatatagcgtcaccatctactttaacaaggaggaatagagatcttacttcaatctctttatttttacggggtagaaaatcgacggcttcttgtatacgccagccgagataccctggagtcctttgaatatcctccaaatgactttctaagatttcccttcctttgtctattaaagcctgttctgtcgttattttcatccccttctccttaatgtgttaatgaaactgcgtaactaagcacaggttcagatattacatcggctacagtaataaaaacgtcttcgtcttgagttgtttctacacgacatacagttacaccattcaccacgaattcaacgcaatgtggaatatcttcacaaacgaaggtagtgtaagtaacacccaaagcatcatacaaagatttaacagtgtttgcaagtgccgcagtttcttctttttctgagacaatgaatgctgtaacaacaagattgtttgcatagtttagactgtcctctatagccaatgatttacaaggtagtaatgcaaaatatttacctggtttaatcagacctgcttcccattgattcaaaattgcttgggatggtttagtaatataaaacagattttcacttgggttatcaatattacttctggcgatacaacgtgaaggattattaatatcaaacacatgatcaaaatctacacaaactggtaaactgaaaggtgtgaattttttacctaataatcctactgctgacaatatgtttgctgtgcttatcttcccgttaaaagctaaacgcatatttaactcctttaactagcaaccgtaacttccgaactttcttctttcgtactgtctacgatatgcctggtggcaatatacgagacttgccagttaccatctggtgtagtctcaataagtaccctatctacttcgagaaaatgcaaaaattcaaccatcgctcgcttcgataggaattgttttttaacagtctcctcaaaagattgaactgccatgtttcctccttatttaatattcaattttgcacaaagacgttgtaccgctttggcatcgaacaaactcccacgaatagttctctttcctgattcattcagatgttttgcaatcgtcatatatggcgttttacaagctctgtatgcaactaaagaatcttttaaagaaagcgcaaactcttttgagcgttttgcttcttccgttttcgtataatctgttcttttgtatttagggtttgctgcaccaagaagcgttcccttcgcttttgctactttaaggctcttcttaacacgatcagatattgcacgagcctcttcttctgccagaactgctaaaatatttattatcatattttcagcggagggcatagttgctattcgtacattaatcatctctaacaaggttgcaacagaagctgtgttacgtccaagacggtcaaccttagcaacaacaagtgtagcacctgtttctttgcaaagattaacagcttttacaagctctctacgttgcttccaatcgcctttacccgaataaaactctgcaaagctacctacaatagtataattttcttgtgaatccaggaagcgttggatatctgcttcctgtgattctataccatactggttgccttgttgtttcttcttagaaagtcgatgatacagtacaaacttcataataccctcctgttctgttacaggaagtatgcactaccttaacgttaaagtcaacagttaagtagtggtaatatcatcttcttgaatatcaggatcaacttctgcaaagatagcttctacaggaatttcttcacctgctattctagaaagaagcactgaaccaatagcttttgcgtgttcttcggattccgcataaacattagtccctgtgtcttttttcttagtttcgttaaaatataccagatagtaattgtatgccattattcttcccaatcgttgttacgagcattttcaagaaccttgacaacttctgcatactctacagctaaaccagcacacacttcagcttgttttgcaattgcttgtttaaagaacatagcgattgcaacactctgtgttgtgtgaatgttatctgctttagttgatacgtgaagatcaaaatcttcttcatcaaaggtgagttccatagtaacaataaatttctcggtcataaaaatgctcctcttaaacaaaatagaaaggttgagttaaacccagcctgttttttgggtcgtagacgtaccaagcatatgctgtcttatcagtaccacctgcaacaaaagatggtcgttcagaaagaacaatcaaatttgttggtggattctgtttatggaattcccttcgtttaatagactctaggaaaccaagacgcaacaagtatatgcaaacgtctgcttcttttaagctcttttgcaagaactcaagtgcaagtttgaatgggggatttgtgattataatatccggcttagtatgccattcgtggttaaaataatctttcccttcttctaactcacaatattctgatccttctggaaaatgttgataaattgcagcagcagcgcctttacacggttctgcaaaaataaaaccttcttctttaaggttattaaaatctattacactaaataatgcatttatacatttttgtggagtaggatagtaatcagttggtggacgatcatacttatttgccactacttaaaatctcctcttttgtgatttcagggtcttcttcaaaaaccataatatctcttaagaacgttaattcttccatagatactggtattgtatcttcttctgtttttcgtttacataaatcgtcaagaaagtttttaaagttttctgacaaatcgtaaaatttcaacagttgataatcacaggaggagatcctatctagttctaacattctttctaagatattttctgtgttgccatacagcacacgaacttctccgaaagggttgactgagtattgtgaagttctgaaccatccctttttagatacagtgtaacgctgttctgctaaactttcaataaaatttttagctcttttacagttttgttctaaagagtagtaggctttttctacaaaggttacaggtactggtaacatatctcctcctaataacccccttgcgggggtttatactagattaattatcagaggacactttatcaagtttttcagagactgtcaatactttttcttgtgattctttcatttctgctaaaatactttcagcttcatcactatcaggatcaccagtcaacagcatactaattagttgctccttgctgaagttcagaatatcttccgctgttagctccagttgttcttcgatctcttcaataaaagtttcaccgccggaaaaagcatctcgtagttttgcaacttccatcgcttcttctggagttgcccctgcatctaaagctgctaaagcaaaatctgccccactaccaacagcataataatcttcagttaaaggatatgctcgcgtgggattattaccctcgtgcatataaattttaccgtctgggtgaacaaccaatgccacaaattcttcatcttctttatcaggatctgactggatcaccaaacctgggattgtctcttgtgctgcttggcattgtaagttttgttcgaaccaagaaaagaaagtcaggatagaagacagacgtcctgcaccaccaacaaggtagtccccaattttacgcactttcttgaaatttaaagtgtctacacgactacctactgttactttaccgtcagacagaattttgttacgtgttgcaataattgttgtcattgtacttcctcctgtagtgttttaaggactgctttaccaccgcttacatatttacggaggtaatcaatagctcttagtgtttctttatccacaagaattttattagttcttgttagtggatgatttagtaaatcactgcaatttcttactaacatagatttcttgtgaaagatactgctaagaaaaagaagtttagaatcttcttcatcaatcaggagtaattctgaattagacccagctatatttattatacactcaaacaagccttcttgactatcagataattcctggtaatatttagttagccaatcctcgccttttaaccaactaaaaaacatctgaactttttgcaaagttgtcatgttctctaaacgaagagatatttctttttcaatcttgtcaatataaatctgtctaaactcattcggcttaactaagccagcttgatagcattcatcaataccattgcgatcaatctcaattagcgtcatttaacctccataacaggcatccttgccttgtaattattaatatacttccgtgatgaactgagacaaacgggaacgttggttatcagcagttgtcatttcaacataaccaataaaatccacaatagcttccctttctccttcttcattaataggaacaacacgatctaacaaatcacctaacccgttagctcttcgtttaattgcatatgtttgattaacatcacccataatgacaatacgtgtattaagacctgctcgctcaaggagaagttttactgtatttggtgacataagttgaacttcatcaataagaataatgctgttatcccacgtagcacctagtgcatagtttggaatattaagttcaattttgccacttgcaatatcgttttccaatttatttgcagtcataaactgttggaaaattcttttagttgattcgtagtgtgctgctagtttatcagtcttatctccagataagaaaccaatttgatcatcacctacttctgtcgggtttttaaggaaaatcaactttctgaaatcaccagctttaagcatttgcaatgctttccacagtgctgttgtcgtttttcctgttcctgctggggcattaacaatggttaaatcattccaaaccatgcttcttacaatagcttcttgattcccaacaggggtaaattcatcaagacggtaatcatcatttcctactgctttagccgcataacgactggcacgtttgtcatcattggctgctgattgacgacgagcctttgcggttttatttcccatgtttgcactccttataaaaggggctttcgcccctttgtttagttataagcgtctaatgttccagttttaagtacctgaattacacgctctgcgcgattaggcgtttggcgataccatttacttttacgtaaatttatatacgtttcagtataatatgaattactcactaaagtcaagctatttttgaaagattctgcacctttcaatcccatttgaaataccatattgataatagccattttacgattaggacttactttatcgtaaataggagataatatggtacttgaatggatttgttgtatcgctttctttacgtcactttcaaagattcttctagcttccgcttcagtaataactccattggtttttctacctactaagttatcaagaatgcgtatagcttctgctttatctttgagttttgtcagaaggtgtccaataccaactgtccaatacccttcggtatcaggatatacagttagctttagtccttcatcaaaacgtaacatatcaaacacatcaactactttagccatgttttccttatattagtcgccctccccatgatctagctcttgaaacagtaggtgttcaggagacatttcacgtttaggcttcgtctttttagtttgggacttaagctctgttgccaaagcacgagaaaagattttacgtttctgtttacctttcatattgttactccgcaatctgagccatgaattcacgtagttcagaaaaacctcctacgtgggttagctgttcaccatcttccacaaaaatctgaggaaatgtgcgtggtagaacacctgttttctctaaaaccagattctgaatctgatctaaagaatagtcttcatctaaggtaaggtatttaaaatcctgttcacgctgttctagtagaatcttagcgttagtgcagaaaggacaatttggtttaccgtagataataaaattcattttcactccttgtttaaaagtatagttaaagttcttacaataccgctatcaacacttcgcggatttaaagtaggatctgtttttaaataagatgttgctggtctgacaggttgaagcagatataggttgaagcagatacaggattaactgtaacagacaaatctataacaagaaatatctttcgtgcaaaatcataccaagaaatataatctgcacctgcatagtgtacaattttactatttacaccatcttttacaagtttaaaaattgtttctgcaagatcaggtgcataagtaggacatgataaatgatcacatactacattaaattctttttgaccaccgttgtagcgttccaacatagttttcaaaaagttatgtccaaattcactataaacagaagctgttctgataataagtgctgtaggacaaactgcttgtactaaagtttcacctaattgtttactgtaaccgtaggtgttcaaggggtttgttttactctcttctgtgccagcaacatgcccatcaaaaacatagtctgttgaaatatgtacaaactgtatcagtaaatcattacatgctttggcaatgtttgttgcaccgtatgcattaacatttatacaggtgttaacatcttcttcagctttatctactgccgtgtaagccgcacaattcacaacaacatcaggcacgtgctgtacaagactattcataacatctttaaagttggtaatgtctgtatcacttgcttcaatcaaaataacatcttcgggcgcaacttttgccaaagactgtcctaattgaccttttgaaccaaagattaaaaattttgtcaaaatatcatctcctttagtgttttggcttgctgatctttttgtgacaagataggtttaaaattaatatcattaaagattaaatcaaaaccccaatctatattgatatctggatcattccacgcaagactacactctgaagtcggatcgtaatattctgtacatttatattcaaaatcagcaatgtcgctaatcacaacaaagccatgagcgaaaccaggaggaatccaaaattgtgttttattcttttcagataaaagaacacctacccattctccaaatgttggactaccaaccctaatatctacagcaacatcataaacttcaccacgaacacagcgtactaacttcccttgtgggtttttcttttgaaaatgaagcccacgtagaactcctcgaatagaacgtgagtggttatcctggaaagttttgtttacctatgtattgatcatataaagcctgattaaaactttctaagaaaaaaccacgttcatctccgtaaacgtcaggttgaatgatcaacaaatcttcgatttttgttgcttgaatcatttaatctcccctttattttaatttaagtaaatacttgccgtagtctgttttacttaaaacctctccagaactttttacagaatctaaagtaatccattcatttttaaaagcaatctcttctaggcatgcaaccttcataccttgttgcttttctattgcatgaacaaattgagatgcttccataagactttcatgtgttcctgtatccagccaagtgaaacctcttcctagcttacagacacgtaaagccttttctttccagtacatctcatttatatctgtgatctctaactcccctctagcagaaggcttaacgcttttttagctttctgtataacagaattatcgtaaaagtacaagcctgtaattgcatagttgctttttggtgcttttggtttttcttcaatacttaccactgtaccttcagaatcaaactcaacaacaccaaatctttcaggatcatttacgtgatacccaaaaatattagctccaccattcttttcaatatgttctttagcagaatctaaaatactaccaaaactctgaccaaagaataaattatcacctagcacaagtgctacagaatcttcaccaataaagttctcaccaataataaacgcttctgctaaaccttttgggctatcctgtattgcatactgtagggaaataccaaaagaagaaccgtcacctagaagatttacaaaattaatttgatcttctggtgttgtaattattagtatttccctaattccagaaagcattaggacagagagtggataataaatcataggtttatcgtaaattggtaatagttgtttactaacccctttagtaactgggtaaagtcttgttccactaccacctgctaagataatacctttcatactcctccttaaactttattttcccaccactctttgttatctacataccaatcaacggttgaataaagtttttcttcaaatgtgcctttagctttccaccctaattccttttcaatcttataaggattcacttcatatcttagatcatgcccaggcctatctgtaaccatctcaatgaggctacaagcatctgtttcagatggatataccgcatccatataatcacaaatcatatagattacatcaatattagttctagggtttctgctcccaatattatatgtttctccagatttgcctttagttactactaggtgtttgtttctcgtgatcgtcaacgtatagccagtctcttacttgaagaccattaccataaacagggattggtttattcattaagatatttgttatcgtcttaggtattagtttttctggatgatgatatgctccaaaattatttgaacaatttgttataactgtcggaataccataagtacgatgccacgctcttaccaaatgatcgcttgcagctttagatgcagcatatggactacttggtttataaggattctgttctgtaaacggataatccccttcttccagatcaccatacacttcatctgttgaaatatgatggaacattttaagatttgatttatctcccattaaacgaacagcttctagaagattaaatgtcccaacaatatttgaatttataaaaacactcggtgatgctattgaattatctacgtgactctctgctgcaagatgcattatataatctggattaacatctgccacaatcttagcagttaactgcgcatttgtcaagtcaacacgacaaaactttacattaggtgtttctgataaattcctagggtctgaagcgtaaccccatttatctataacgtaaatatcattcttagtatttttagctaggaaacgaactaccgcacttccaataaagcctaaaccacctgttactaagtatttcatttagtctccttccaattattcccttcagtaaaaataataccttcataaaataaccatctggaacctttttcaacaggaacaggaagctcttcttcagtaaagttataaacctctctagcatcttctaaaagtgatgcaaatgtttttggacttactgttacgcgaggagcattgatcagttgatctagcatcattctactatcctccttaccaaacgtgttgagaaataatagtttccgtttcaatgttatatttttcaagaagttgtgcataggcttcttttgcatttttatttagttgctcaagatctacagctacacttccttcgccaccttctaaataaatgccatatatgcaataagattcatcagcgtcatagaaaggagagatacgacctgtctcttataccttcttgtaagaaccagttaaagtctccatcaaattcttcttcaattctaggatcttctcctacagcttcttcccatttattaaaaggtgcgccctgtaacatacgccattcaatattagtccccattatcttcctcttcttcttcagtatgaacgaaacctaaaccgttacaattccaacaaggaataaattgttccatactaacaataaaattcccagtaccaccgcagataggacaaatacttacatcatccattattaaagctcctcaatcttttctaacatctgttttaactcattctctgttaacagaatttctgtgataccatcataagtttctaccatcagagtaaaacatttctctccatctgaacacgcaaaagcaccaccttcatcttctgttaagtcagaattaatatctacatcaacaaaatcaatcatctttttctcctttgataatttcaaacttggctacaccattaactataatgtgaccgcaagacataactcctagccaatgatcaccattcttttttaaacgtttaccgtaaacatcacagaaaccattctgtaattcggaagcctcataagaggctcccttttcgaaaacgtctttgaagtcagaaattaatccaacacaaagtagtttcattaaaagtctaactcctcgtcatcacttacatctttatttgctgaattcagtttgtaagctgtaatttggatctcctgtgctgctgcttgaatttgatctggatttaaccaaacatccatccaaggcagtggacttttcttcggtgcacggaatttgtgtttcattttcagtctgcgatagataggcgcagcattgaagtaaacccaaagtttgaacaactctgcgttaccaccaacgataatccttccttcactaaacagatagtcacaccaatcttcctcttgtccaactaccgtgtcaagaatttctgtcagaacgtcgatattatcttcgtatacttttctccagacaggatctttcagcagtgcatcaataatagcataatccattttaacgtgcaatagttcatccaacataattttttgaatgagtttagctgcacctacaaacagttgctgctctgctaaggcaaatgttgcagcaaaagatgatatgaattgaatgccttccagaccgataagtgcaatcattcctttcagaatcagtagacgaaggttatcatccttctcaatcagacctagagcatatttatgccctgcctctgccagatcactcattatctcttcaactatacccatcctctggaagattctttcgttctccataatctgatcgataacttcatttggattagggatacactgacgaataatttcagaatatgtcaaagcgtgtaaaacttccatttctgattgcttcatcatcattgcacatgcttcgttgttgcttaaaaatggtgcaaacaaagtgatgattgatttagcaagtgaatcattttcccactggaaagataggtttttgatcataacatcatagttgcttttagaacaagctacgaaatcttttcgtgtctgatctaagtttacttcgttttcatcccagtcttgctgtttttgtagtttgtacagacgatgcatttctgggtatgttacattaatagaatcaaaaatacctaactgttctcccaaaaacacagggtagaaaccttctttgtaagtgtcgttgtataagttaattgctgccatttaaatcctccacaatatcgcacattgcttttattgtatcaatgtgttctctctccataccatgctctatgtaagccttctctaatgcgtcccatacactctttgtgagtagcacagtaacctctccctcataccttgccctggttaaagcataccaggtagctatgggatcattggaagcccatatttcaacactggaaaattgaaaacctgcaatataatgacaacaccaatcgaatgtaaaatctttactatctaccagtgtataatttccccagcgtctttgtggtgttgccccaggtaatacaactaatgtaggcatattcctccttaagaaagggggacaaagccccctagtttcattacatcttacaagcctcacaaccggattcttcatcctcttgagcgagtgaggttgccgattttgttctgctatttagatagtacaaagatttaccaccaagttttgcaaactgaagaatatattgcatttctgatttaatggataaacgaccaccttccatcttagaatagtcaatccacttatcacatgatgcaccttgatctaagaatttagtcaacagtccatatgcttcagccatatctttatctggtgtatcccaagccgattggtaaatatcttttagtttatcgtagtctggcacaataaacagaacattacccttttggctttgtttataaactatagtatcacgtacaggatacacagagttagtcgtattacttacaagactactggactcatttggagcaatagctgctaatacgctatttcggataccaccttgtgcaatgatatcttgtcgtaaaccttcccaatccattttaagtttaaaattgccaatatcgtctacagctttagcgtaggtgtcaataggcaaccatccttcaggccatttggttttatgcatccattctgcattacctttctcttttgccaaacgaagagaagctcttgctaaccaataataatgtctttctgctaattcgtgaattagttttttgccgtaaggatctgaataagtaacaaaattacttgccagataatgtgcaaggtttgtaatacctacgccgatagacctacgtgctttagcagtgatttcgttatgtttaaacggatactgcattgtttcaataacattatcaatagtcagaacggtataatatgcaacatcttcatattcttctggtgtaacacgaccagctacaatagaagacaggaagcataatgccaattcttgatcttctgtattctcacctgtgaaaagatcagtcatattgtgaaatgctttcgtaggtaagaaaatttcttggcacaagtttgactggtaaataacatccttaaacggagtatgcttattagcattatccgcaaagaacatataaatacgtcctgtctctgctctttgtgtaataatttctgccagaagatctcgtgcttttacaaacttcttcttaattcgtttgcgactaactttttcatatacttcttcaaactcttcctcgcttttataaagcgcctcatagagttctggtgcttcgtcataactgactagcatccaatctttaccttttgctgcacggcgcaggaaagcattgtttactacaatagagtaatcaagtttatctactcgtttttcactaacagtagttggatttttcaaacgtaccagatcttcaaaatcaggttccaatattgtaaacgttactgttgcacttccaccacggcttgcttgttttgatgctccaacacttgtttccatccatttcagatatggtaaaagaccaccgtgaacgatacggttgttcttaaccccttgtcctgtagcacgggtttggaggttaacaccaatacctgcattattcaatgtatattcatgagcaagatagttagcaattgctaaagattctgctgtatcatctgctctaaacagacaacaagaagcactacctttaatcttagtacgcaaagttgttaaataaggcgatggtaaattaatcttaagatcacttacgtaggtatatagacgtttaatgtcttctactctgcgatcttttggttgaatttccattaccttcattgctacaccaatgaataaaaactgtggtgattcaaaaacaacatcattgatcgcatctttcacaagatacttatcaaccatctggcgcagtacggaataaccataagttaagtttttatcgtgattgacaattttaccaatctcgataatttcttcttctgtataatccatttttccccaatagcctttacttacagacatattgtagaaatccaggagggaggggatattgtgatatcccccatgagcctgtttataaatcataccaagaagtaaccgacctgccatatcactatatgcctgatctttcttatcaatacatgctgctatcatagctttatgtaaatcacgagtaggcacaccgtcgtaacaacgtttaacagcttcaagttcaatttcagaccaatttaatttaccagcagcaaactctgaccatttacgaagtttttctggattaaattcttctttcttgccgtttgtttttgttacataacggatagatttgcttagatactgagtcacttcctctcctattaattatgcatatttagaacatctacatcataaccgccacgcatctcattatataagccatttgcgtatagaaaaccttcaaaatgatctataccttcaaaaccttttgcctttgctttgcggtctgcttcttgtctttttggggataatcttttagatgtatcaaggataactgttacattgcaacctaatgtttcatcaaaatagacttcaatttcacagccttcatatttattactttctgtcatttggcctctcaattagaattcagaatcatcatctcgtgatggatcatgttcatttccgaagtcttccattttgatatgagagctaccccaacctgtaaaatcttcttctccaaagtgcaaaatatctacaccttgatagattcgcttatatttatagtcttgtcgaactgggaaagtatacaatgtagtatttgcaaacaccacacgtcgattgttgttactacgaatattaacaccacgttctactgtataatgtccatcggtagacataccaagcattactaatgctgctcgcaatgtagtgttatgatactcgtgaggaatttttcctccgtgctttttagccatttctttccagatcggtgtagccttaatggtagacatacttacggtcgcccaaatggttgtattaattagtgacataaattctccttctctcttttaaggagagcatagctctcctaacgttagcctatactacacgaatctcaattaaaagtcaactataattttaagttgatcaccattttgtatggttagtcaaaagttgacgatgttgaatccaaccacagaagtttccactccacaaacgatgtttacgatccatgtgtgtaataccttcttcccaagaagtagggaacggaggaatattaataccacctttctgttgttttaatcctgacaaatccatttctttcattggcgttgcctggtgttcaaacggagatgcatgtaccttttgtccagacagcaaacgagaatagatatccaatgctttatctttagtatcattcaatttacgataacttacctgagcgcaacaagaagctgaaatagcttttgcttcctcttctgtcaacattttctcgttggagaaggtttcacccaagaaataacggatcataccagtttctggatctcgatcacgattaacgtaaggtgtatgccattcccctgggaaaagaagatatgattcagaagattcatacagttttttaatttctttagcaagagcctcaatagtaggatctgcatcagcatctacgcgcaaccacaagaagttttctagctctgtagtggttactacagtcttcatacgttggaatggttctagtaggcggtttgcaacctgtttatgataaccagcaagggcaaactcttctgcaaaacgtgcagcacttagcgcagctaagtcccaccattcttttgcagtgtaacctgcatcaatcagggcatcgtgatctgtgcctttatcttgcatacctggttggttagcaccaaaacgataaggacgtgctggagattgccgtaccatttcaattagagttttaacaggaatagctcgacttgatgcggcattacgagaaaacaaacgatgcgtcatcaattcagagtgaatgattcggggatattcaagttcaaaggtaacaatatccttaccttcagatgtttgagagtgtgcaataatttttgctgaaatagaatttgtcattatttctccttaaggtagtaaaatactttcaatttcttcccactgattatctaaaccagtgataattacattaggaagtttctttaactcttccaagtatggatcttcgtaaatagtgttgaaatatattttcaacgtttcatctggaaataggacaagattttcagccctatcgtcaatagttacgtcgcaaggtaataagtatttttcttttgttgcgaaaaaaccattaccagatgttctactaaagtccactttatctaaagatcgtgttacgtgtctatatttagaactaaggtgtccacccttagtgtggcttgctatagatatattagctccatttgcaattatacgatgaacaacatctgtactattaggtactactcccatagtatcatatagatgttggttatcccaaaaagagtaaggatctacaccaaattgctttttaaaatcgggaaaatatttcgtaatatcataatgcacagtcttatgtgcattatcaaacttgatattagatctacttaccgcatttaaccaatttaaccattctatatccgcaggagctattactaaatcccaatcacatactagacgcattatttctcctgttataacattttctacacattgtttcgtaaatgtcttctcccccaataacaatctgttctttagagtcgataagtctagcattaaaaatagcctttcttccacatttacaaatgcttttcaattctgtaattgaatctgctatggctaataaccgttcagaaccttcaaacaattctgtagcaaaatctgttttaagtccatagcagaatacaggaatatcgtaattatctaccacatctccaagaatgtcaaccatatctttagttaggaattgtgattcatccacaaatactgcatctactggattttctttaagctgtgtataaatttccagcatatcttcttttgttttaactggttttgcttcctctttaatacctatcctagaagcaatagcacaaccagatctggtatctaaagccgaagttaaaagaagaactttcatatttctctctttatagttccaagctgtttgtaaaagatgtgtgcttttaccactgttcattggactatatcggaaataaagtttagccatattttctcctctaacgctcccatttgtgggagcgataatactttattatttctcttcgtcaagaagaatttttactatttgttttcttcgcttacttactgtactttctggtgaaattccgcgcttcgttagccaatttttatcctttttagattggcataaagctatcgcttctttctccgcttttgcttccctgaatgtcatatcgtgcttgtcagcataagccaggatagcgttacactgcttacaaactacacgcaggtcgtcttctgttacatacaataggcgtaaaacaaaacttgggatatcttcataacaggttaatgtacctgctgcattaatatggtctacttgaaagtctttcatacctcctgtatgtccacacaattcacatttacaattccaaacctgtttcggtttgcctgttttcttatctaaaactacattgccatctttatccaacctatcggctttaaatcgtacagattggatcttttttatcttattcgggtgtctcacccatgctttccttaagcaaccccttaaatatgtataaaaggctgcttgagttttccaaggtgttccatctccccaaataactttaggttctttattttccaatagtgctcaccttttcaacttcagagaatgcttcaacccatagcaatacttaaagaaaagcatacggtctaaaccagctttacacatgttttctgggattgtgattgtatataggagtttatctccacgtttattgtatattttatatacttcaccctctccgtattgtttaccgtgagaagccatctacactctccttcaatgtttcaatagcatctgctgcttcaatatacttacctttgtacattgcttttaaagccttacgaacaagatcatcgtctgtgtataaatcaattagctgattagctaactcaatttttacaggattttttaagttagggtaggcttcatacaacatattgtaatacttatcacttaattctttttcaatatgaataacgtgaatcgctttgtttaggttgatcacacgatcacctttgtttcgacaagcatacttagctaacttagtgaaacaaggagttgcaccaattagatatgcaagttccaaaggttgcatacgcatacgtttgtagtgatcaccatcaatttgaatatccagtgctgtagtcataaatcctccaaaaataaaggggctttcgccccttttttattaaattccaataacagtgtttacacgcttctctttgctacgcaaattaacacgtccacgagacaggctattacatgatgtgcatcttagcacttggaatgtactaaccgctgttgtgtaaaccttaccaggaacaacttcaaggtgctctttaccgcaacgaggacaacgaagtttttcatcgtcatagaatgcagatacgttaggatgttgtggaatccatgcacgaagtttgatgtaaagatctctaagagaaacaacatcaccatcattgtatgtttgcatacggaagaaggcatgtctatctccttcacaacatgctttccacaaaggaaaaccttcattatcaagtttaaagttttctgtatcaaaatacaaacacatttctttaagcgcattagaaggtagtgcaaactgcttcttagctgccttgagtgtatcaattacaacataatgtgatggtggctccataccgtgaaaagcaaaacgttggttaatataagccttatcaaacttaataccattgtgcgcgatcacaatatctgcatcgtcaagtaagtgccagagatcttgacataattcccaatcatctgtatgatctatgtcaaacaaagggtaattgctaaggttcttaccttctacttcccctgtttctaaatcagcagatgaataggaaagcaagtaacctcgacgaataacttgttcaggtgcaataaaggctttgaaacgtgagaagctatacacaatctccggtgctgtctctacgtcaataattttaattactggcccacctttatcttgcggagcaccgcgatgtggtgaatttacacgagctaagtaatcatttactgtgctcttcttagtagaacttcccaacacctcttgtgcaatcttacgcgaagaataaccttgtgctttcatagatacaatcaaggctttctgttcgtctgttaatttactcaatgttcctcctgctctgaaatatatgcttgtagcatactttcaaaagttgtttcatcattcgcccaacgtttcatatataccaactgaaaaattgtctctatccattcatcagttgtcatttctacttcttcaccatcccaagaagtaaatttaacgccatctgggaaccattcataatactgatctttaactgtctgaaaaagttcagcctgtgttttacatttggaaataagattaaagcaagtaatatctccaaatttaacatcgaagtcttggtaaggtcgaatactatctgtcttatcgcccattagcatttgataagctaaccagtaactaccccaacccttaacttcttttttcttacctttttctacgatccagatatcaccgatagattcatcaatcagaataacacaagggtttttataaacaccatcctctttataaaagttaaagagtaaacttggtgtatgtaagctatctttgtcgatagatgctacaatatgagaaaacttaccagtttccttgtaggctttataccctgcatatccatagatttctaaagcatcatctgcctcaataccagtaacaacgtcaccgttatgtttttcaactagataatctttagtatctgataattggattggtcttaaatctgatcgttctgatttatattcttttggcattttgaaagaatgccggaaggtttttcctaccccgatgacaccgcaatacttttgaagttttaggtgatccatcatctgggttatttttgtctttgcagcttgaaacgtaaaagaaatattctctgggactatttgaacatcttttatttcaaaatcttctttggagaacaacttcttaccagcagcttcgcgttgcgcgttaagtgctcctaaccatcctccaatattttttgaagatttaccccaaaaatctgttcttgtttcaaactcttttacattaccggaagccttgtgtacagcgtggatttttctttgttctaaagctgaagacgcttggaacgccacttgatcgtagtctattgcaagaattgtgttctcgtcaacatatttgtgcagatcttccggttggattaaaatgtaaccgctaatattacctcctattcatcatctgaactctctgttgagaatgttcgtgtgtagggacactgacgacttgcagaaacctctataaccttgtcgtacataccgttagagtaaaaacagtattttgtacttccagaaacttgttctccagaattaattaaagttatttgaccagcataagaataagaactgattactaaaagtaaaccgacaagaagttttttcatggtgtgtctccttaaaagcccacctaactaagtaggtaggcatattaacacatattaaattagtaagtcaagtattatttttgaatagttgacttaataaggtcttgcataataccacggatttcattaaagcacagaagaacagatgcttcaaaagatccttcttcatcgttaaagtatttagggaatttaataccactcaacttaaattctttatcaacaataaagttaacgaaaccgtcatattccaggccaatggcaacaacgtgcttaccatcttccataagttctactgcacgagattcataaagggattctttactccatacaaccacaccttccgaatcttcaagtttaatataattaccaagagtcagtcgttcagcctcatgttcttctaagatggtatcaaaacctttaataatggcttcttcgtgtacactaaacggcaggactgggaaagtacccaacacctcacgaagaaatacagcaatatcttcactaattttcttagaaccattaagaacataggtaatactgttttcagtgtctacaacaacatagttatagaaatcatctgcctctgtttctggaagcagagaaaacacgatatcagcctcaattgcttttttactttctttgtccaagaaaaattctttagtagggtttgcagcaataaactcttgttccatctcttggagtttttcattaagaatgcgtttaacttttttcttgttaacttttttaaaagattgcccaccttaaataacctctaaaccgagaaaaccttttaataggagccatcatcttcaaaacgaacaagaccaatggtatgtgcttgttgcccctgtgccacaacaaaatccagcggtttgtctgttactgtgttcagtgctgaaatagacagaccatcaccagaaatcagggttacgcaagatttgaaatttttagcaaacatagttttctcctcaaataataactacaaaatattttacaccatcatattcgacaatatgatcaggatatttaaatcctttataagatttaccaaacagactaacagcttcattagctttgttttgcggattactcaaccactgttcttctgtgtaaaacttaaactctgttctcttaccttctttttctaaaccaacaatttcctgtgtgatatcttcaatacctgcattcttcaaggatttgattacctgacgcaaaccgtgtttaaagatatcttctgctgttaacataatacctccaataagcccccgaaggggctttatttcttaagcaatgattgctgcgatattaggtttaacaaaggtagatggtttcataattttacctttgtcatcaaagaatacgtacaccttttgaacttcgttatatacagcatgtaccccagtataagaaccttctgcacgatctttgcttcgcatctcgatagcatcgcattctttttcaagagcttcaataatatccttagtttcccaaatagccaggagttgcttcttggtaggatacttggactcattgctattcaacacttcacgcataaccttcttctcgttatagacagaacgtaccaaagtatctcgtgccatacgtgtaagtgtaagagacattagggcaaattgcaagtcattttctaccattttatcaaattcaatgataacatcgtaaatgttttctgccagaacatcccctgtcggcatttccagagctttatcaacaccttctttaccaaagaacataaatgccaggtaggaggctaccacaaaaatatctgctgctgcatcaagtaattcaacgtgatcattttcctgtgctgctgcttggaactctttaagttcttctcgtacaaaagaaagttgagcttcaaacatctcttgagtaaattctggagttactccaccacgtgccttagcattccaagcaacaatttgatcggcagctttgataaagaagctattgtccacttttacttgtttgaaaaaattctcgatcattgtttctccttatttaaaatattgttctaacaaaacactaatgcgaactacagattcgcccatatacgccccagcaccaccgtagacaatcatcagactagccttctgccaccatgtcgggtgagggaaagttgatgcgacaattataccacaagcaacaatagaaagcaacacaagaatcaaaataacttcaatgctcactgcaacctcctttatgttttaatcttgccaaaatacaatacttcagcttcctgtcttgctgatatagcatcttcaatatcaataaatgctccaagacggatatcttttccttgataggatatacgagcaatccatcttttttctttctcgctccacacaacacctgttttaccagaagtgttatttttctgttttcgtgtattgtatgactggacagaccttgtagcccagcgacaattttctttactgtaatctttttccgagtctattctgtcaagagataaacctttaggtctatctcccatatcctcaaagaatgcagagaatgaatttctccaagcatcacaaaccttaataccacgaccaccgtagtattcaaagtgagtattgtttttgttatagcatctccctaacatagcttcccacgatttgtatgctcctgtttgtgttgttttcggtctacacttggaacaataagaacttctatttttcctaagtgttgccatagttaccgtgcaaatattaccacaatcacaagaacaagtaaaacgtcttttgccatgtttgtccctttcaatctcttctaagacagtataacaaccacatttcttacctacaaggtctactctcttggctcccatgttccctccaccatctcccgtaaacggacacctgttggttttgtaggtattccaccatcggaaaactcttcatactcaatctcaacaaatttaccaattaacatttcggcattttctgctttacgatagttaatggtttcatctgaatccttacgcatcaggaattcgactactttaccattttccatctcgcctgtcaataccccgtcaccatttttatcacgctttgcacttactaccttaacttcaagcgtctgccgtggtttacgtttaataacatcataagaacgcttatcaaactcgtaaacaccttgtgcgttacgatacaccacaccttccgctttctcacgcagagcttttgcatagaattcatcaaactgctcttggttttcaatgtactctgtatgtactacacaaataagttcatctaaacctttatcttcaataacgtcttttagagcagccaaaacttcaaccctcttctcaaatggtacagatggcacaggaacatcatatacatagtatttaagaagcggagtgttagcattatgctttttccacgcactattaatttgttgaaggctaaggacacccaaaccagcaaaaacttcaccgtcaagaggatgaccaactacttctttaatgaaggttggaatttctttccagtgaggtggaagtttatatacttccccagctttagataaacattcaccttgcatgttaatcattgaacgtagaccattcaatttatattgtgcataacctgggaacaaaacacgatcagcataatctttataatcctgacatttcatgggtgtggaaggaacatggttttcagcttcctcttttgttttataatacccattcttaagttgttttgtccatttggcaagagcttctatttcagcttgttcttctgctgttgtttcatttgagcgaccaatatttttaggttctgctgtataagatttgctagtgatctttccacctaattgaccatgagcaacagttacaacactaccttcggtatagactgaccactgtttaattttacctgtagaagttttaccatacaatgtaggattagtttgtttcatctttaacctccagttgcgaaagaacccatttagccatttcaatttcaccgtgtagtctgcctagttcataggcatcatcaatattaccaccagtgtaatcatccaccataaagtaaggatcttcactactgttaggcgcgtttgcaattctcgttagttcttcaataaatgtcatagttaaccttaccaattatacacaagagtttgaatttcttccatcaagtcttcaagatctgtatcaacatattcagaagatgttgccataaagtatgtaatcattgtgaacccttcagaagagagggcatcaaggatatcattaaacatatcttccatttcagtattctcaccaaatgaaaataacatttgttgatcttcgcttacacctttaacatagatagctgtactcatatattaatccttaagacgttcatttaaatctgcaataacatcacctaaatcttcacattctagggttaactctgaaacttgtccattcaaataacaaacttcttcatttagatctgaaataatgttttctaatgaatctacttggtcatcatatgaacgttttgtttcttcaaggtcttccataagactatcaatcaaatgcagcaaagataagatatagccgtctcctgtctcgttcctccactcacttccgtagcgataaataataatttcaccattatcgactactgtaaaatacttaccttcaccagaataaatttccatacactctccttattgtagcttaagtgaactgcgaagacgtttttcttgctgatcacgaatatgttgtggaacctcatgaattgaatcgttaccgtgcctattttcaactactaaagagataacttgataaccaaactcttcagcaagagttaaataaggtttaagttctttctctgtggttgaagtgttagagacaataatctttttaatattagatgccatagcatcacgaacaatactctgacaccatgcgtgtgctttacctacattctctggcttccaatcgtaaacaccactttctgtgtaatgatattgatctgcctcacagataggccaataaccttcagaaataatttctgctactgtagatttacctgcacctgaaacaccacgtaagatgataagttgtttcatttagcctccaaagaagttttctatttctttacgtctctcttgtggatcgagagcagcccattgagccttcgtaaatttatttcgaagccattctagcaaagtataatattcttcgtcaacaatttgtttagcattgtttgggttgtcccaaatcatatcccacttcttattgccaccacgcataaggaatttcttagcaagatagtatggtgacttaatctttaacagtaagttaaacgggtagtttgtttcacgaacaacaaacccttcgtgtttacaatgtttagacatttcaacaacatctgaaaatttaatcatcggataaacttcaggacgtttaaactttgtaatagatgcaatcccatcaagaacaccttcaggtaacatgaaacttgtcccatcaagattttgaattcttgctccaattaagtatgcgcctggttcttcttcgacaatatgtggatcagaaggatcacagatttcaaaaagaaaagttgcttttgcactttctgtccacttaatgaaatactctatgtcgtcacactcggaaacaatacggttctttgccataattgcaaaatctgattctagactccctgttgttgatacaacaagtttccctttgtacacacctacagatgccataaaaccgtttactttacggacagcatctacaatttcgtctgctggaagatctgtaccattttcaaaacgattaaagattttagtaaaaggccaaataacaacattgtcttctgagtcaacaaccaacccacgacaatctaaaagtcgtttgtcaacgttccacaagttatcccagaatacattgtttttgtatttaagtacagcaagaccagcatactctccagatttaacttcttttttatgcactaaaccttttgcaatcaggtcatcacaattgaacttagccaccttaatctcctttgattatcttatgatgatctacaacaataatatcacgcttatccataatagaaatgatttcgtcaaaatgcaagattttcccgtgtgcatcccaaccaacatccaacattttcccatacaaatgatcagggaatgatccgtgagagtgtccgtgtagcatgattgatccatgcccttgtttattccaggcagccatagggtaatgacttaagacgaagaacagcttctgatatttcacttcgtcataatacacaacttctccatactctgcaagcacttttctgtgtttactataatcatggttcccaacacagtaagtaatatccccttggagacgggaagcaatcttacgggtatcttcttcagtcccgaaacagaagtccccaagatggtacatctttactcctggtgttgtggcacatttattccatgcttcgatcagtgcttctgtcatatgctccatatcttcccacggacgatattcaggagcaaactctcggatacgtttgtgcataaaatgcaaatcacttgtaataaacattagtataatccctcgctgaatagttcactgttgtgaccatttctttcgtagttaatttgtttggcgttatctgcaatgatataagcatctttgcgactccaccagttataatactgatcaataaacccttgattatcaggtaagcaaaacagtttatcaatcaatcctgcatcttttaaaacattaagttgtgcagatagtacaggatttgcatgcctaacacaaggaataattaactcttcgccattattgagaatatacttattcgcagcgcagactataacacgttgagcatagtgatcctcaccaatccaggtaagaggttggtaacaaatatcatgttgattagtagcgcacatcaattttccccatattcttttaatctatcagcgaaaaaactgtaatcaggaagtaaaagatcattactcatatcgttacagttttcttcctctttatagataaaacgcccttcatcctcttcttgctctgaccaaactgagtaatgcataatacctacttaatagttaacacgtttaatttcaacaccataggatgaaataaaattttccttagctaacatatatttaccagcagcagaaggatttgatgtatgaacatagatagttttaagagcatcccattcacccgcgtacaacatacattctacgtctaagaacgcatgatatccttcttgatcttctccaagatcattatcgaagtgtatctctgagatattattgaaattatcttcatctgaaacaaaagatgaccaatccacaaaagattttaaccaaatggcatcctcataaccataatctttaggatctcttaaatcgtctaaccaaagaattttagccactatcaacccccttcctgtttctcttctttccaagttttaccattatctaccaacttcttagaaacagcaaatctttctccattgatataaaacaaataaagaataaaggattttcctatagttacagtatctgctacttctacacgctttacaccttgcatgtatttggctttacctgaataaataagaaacattacttattccttttgttgttgatcacatctaaagctgtgtaaggtttgtttgtaccgctgtattcaagaataattggtacatattcatagaccaactcaaaagtaccatacacagaatctgcaactgaaataagcatttcagtgccttcgtcgttcttaattaatgaaaatcttacccctggtttattgagcacttcatatttcttacctgctgtcagcaaacctgaataccattcattttgcacaacagacaaacacttcagataagtttttctcatttctttttgctccttcttttaggcttctcgtataaacctaacacagccgattcttttgcacaaataggaactgacttcattcctcgttttttagcttctggtagattcaaaacccaccagccaaaccagtacaattcatcttctgtgaaaggatctgccataggatctgcatcacgtgcttcaaatttagcaagagcttcttctatcttttctattggagtatcaaagacaaaagcctctgtgtcaaatttttgtttcttaggagcggcttttgccgccccatctttagatgcgcgctttgttacggatcgcttcttcggtgttttcgccatcaacaacctccatgcggtgtaagaaatcttgctggaatcgccaatactgttgaccagtccttacatcttcgtagatcacaacaggatcaaatactttagatacacccgctggtttaggaaagccaactacacgatataaaccgcctttgctaatacaagaatatgttacatcagttaaaatttcttttttcatttcttaataaactccaatacaggtacgtgatcagcagttaaagttacacaattgtaactcaccttttcaacttcagagaatgcttcaacccaaagcaagaaattctctttagcttcttcataattcaatgttgacttaacaacatggaactcaccaaggatgactctatagattgtttgcatagtttgattcatttatttttcctttgtttaaaatgtgttaaacaatcgcaaatgcttgtgacgcactttgtgatcccactaattaatgtcagcactatgattgttgagagtataggatactccatcgcccaagtcaacatgaatctcaactcctaactgtctttctaatggtaaacgttttgagaattgataattacaaagtttacagtctaagtcaagcaattcatgtttgcttaaacctaggatgataactttgcttcccactgtccactcaataccttcaaagttatctcttcttttcaaaatgtcaagtaagaagatgatttgttgccattccgtagacaagtcttcttcatagaacgcagaacaaaaagttttatcatcgtagaaagcatacattatgcctccatctattgtttcacttctaacgtaacgtgtgaccctcattatttcctcctgtacggctctgtaacgagctaatagcctctaagatatgcaatcaccttacctcacagtaaaactcgttacaatcgtttttaggaggtttaggttgtacttaaaaataatctaaaaaggtgttgacaaacgcaaaaaagtatgctaccctaacccccgaaaaacgccgagcgcagcgagggggtgttatctaatcttgtgatacatgatctaacagacaactgagtagtctacatatagcactatgttatgtctataatactaacatacatactctatactaacaatagattctttattaattttattattaattaaataataaatatctattgactttagatctatctgtatgtagagtagagaacataaagtcctaactcaactaaggagataaacaatgaaagttagtattctacatggtgttgactgttatgttactgatgtagacgttaaagtctttacattctctggtggagaacaacatgttcaactagatacgaatctatcaggtttcaatcatgctacagacagaatcttactctctttagaagtaagatctgctaaagacttgatgactttggttatgactaagaatgcattggacaatatgctatatcataaaccatattgtgttgatttactcatgctgtatgtgccatatgcacgacaagacagagtgtgtgaacctggggaagcattcggagttaaagcatttgcttctataattaattcattaaatttctcacgtgttatcgttgctgatccacatagtgatgttactccagcagtgtttgacagactctgtgtaatacctcaagaagagattgcttacgaaactttaaaatggaagttacgtatggagaattttgctcttgttagccctgatggtggtgctcttaagaaaatatttaaattatctaagaaaatgtctttagatgtgttctgtgcagagaaggttagagataccgcaacaggtgctattgttcgtacagacatttctgtacaggatttcaataagcgtaacctgatgatcgtagatgatatctgtgatggtggtagaacttttatcgaattggctaaagtgctacgtgctcgtaacgcaggtaagattgagttatatgttacacacggtatcttttctaaaggtcttaaagagttaagtgagcactttgactgcattcattctcttaatgtgtgggaagataacatccaagaagattccggtgttcttgttaagaatcagtcagatttgcaacaacaaattgtatctccatacgtgtggaatttttaaataataagtgttgacaacagggagtatgcttagtaagatactcccacactaacaaacaaggagacataactatgaatatttttgcaccttttgctactgattggtataaacctggtcacaagcagatgtacaaccaaaatacaaaactcattttctctaatttaactcctcgtaatgataaaaactttgcacactatgcagatcgtgaagcacgtggtgtgattgttttaggtattcgtcgagcagtcaccgatgcccttgtaactatgtgggacagcttctttaaaatgtctcgtagtgcagcagtaaataaattttatcgtatgtctaaaaatgcattaggtgcttctgctccttctgctgaatgttggggagaattgcacgatttaggttatcttccgctagaagttcgatctctgccagaaggtgttttgtgtcctattggtgttcctgtgtttactgtgcataacactttagaaaaattcttttggttaactaactatgtggaaacactattgtcagatgaaacttggaagacaatgactaacgccacagcagcttttcagtataagcgtatcgctatggcgtatgcgatggcaacgtgtgataacattgatcacgttaatttccagtgtcatgactttagtctacgtggcttaagcaatatcgaagatggttataagagtggtatcgctcatttggcatctttcacaggaacagataatattctggctattgaaactgtgcatgattactatggtattgattatgatcaatttgttgcaggttctattccggcaacagaacattcagtagcaacgactaacattggagctattgttgaagatctgaagaaacatttcccacatcttaaagatgatgttgatgggcttcgttatgtagcagagaaagagtttcttcgccgctatattgaagaaattgttccagaaggtttttgttcatatgtagcagattcttatgattactgggctgtcttgactcgcattctggtagaattgaaagagtccattatgtcacgaaatggtcgtcttgttattcgtccagattcaggagatccggttaaagttgttgcaggatacaatgttgaatcttttgataactatgaagaccttttaaataatggtattgctacagccactgaagtagtacatttggctgatgttaataagtattacaatgttcttcaggattgcagtgttgctgattgtattgatgaaacttatgagattccttattgtgaagcagtaggttctattcaaatcctttgggaagtgtttggcggtactatcaaccgaaaaggctacaaggttcttgatcagcacatcggtatgatttatggtgattctattactgttgaacgagaacacgaaatcttacgccgactgaagaagaaaggctttgctgcttccaatattgtatttggtgttggtagttatacttatcagttcaatacacgagatacttttggttttgctgttaaagcaacaggtagtatcatcggtgaacacgaaattttggtaagtaaggagcctaaaactgatcctggtaaacgctctgcaaaaggttttattaaggttgttaaggatacaaatggtaaactttctcttgtggataatctttcttttaaagatatccaagatgaagacaatgagttaaaagttatcttcagggatggtacggttattacaccacaagtagaaggacgtgatgaaacatttactgatatccgtaaccgtgttgatgtagaggttcttcgtactatgggaaccatccaggttgactaaataaaaacttcgtgataagattaaggtaaggagagcctgcaactgccctggatgggcttcacgaaggatttatgaaacaacataatttttattttcgttgccgagcctgtaacagacacttgactaatcactcccgtagagacaggaatggtaatattcaagagtcggatctatgctcgatttgtacaagtttggcattcgacgacagtcccgaaagggtttatcaacatcaaagtgtaactgatcttcttctaaattacacagcaccagaggaggaattagatttcacataattaaggaaacagtatgtctacagaaattatttttggcttatctgtttttattgctcttgtatcttttgtatgcggttatacactaggttacagatcaagaaaaaatattgtaaaaactagttgacaacatagctagttatttgctaagataagcccaagttaaacaaaaaggagaaaactatgacagaacgtacttatggtaaagaattgattgagaagcacgtattgattgataataaaggtggagcaatctttatttttgaacctgaatcagttcttactgaaaacgaaaatggtagcgttagccttaaaacagaaagtttggtaattgacttccttgctcttctggatgaaatggggcttcctcacgaagaagaagcagctattgctttgattgcagttcttctggagaaacgcgaagctggtgaaatgacccagtatgcttaatattcaaggttccatagctcactgacgagagcgcacacctcataagtgtcgagggcagggattgtaaccctggggaaccaccatttaaaaggaggtgctatgcatctcctatatgcaagtgtggtggaattggtgatacacattgtgcttaaaacgcaacgcttaaatgcttgagggttcgaatccctccacttgcaccaacacctaaaaacatcttgacatttacttagttttttgttatagttactatgaaaacggggtgtatctcacctgacttctaatcaggcgttaaccgagtaattggagtatgcaggttcgaatcctgtcaccccggccaaaaagttttaaaaactacttgacaagcaagatagttttatgttagatttaaagtataataactggaaggtagggcgcagcggtgcgcaaccaggtttgaaccctggcccattgtagcgatacggtgatggttcgactccattatcttcctccaaattctcttaggagctttatgaattataaaactattggacaggttgttaccggagttaagattgtaaataataaagttgtttatgagtattctaatcttcaacaatctgaagatggtaagaatattcgtatggtaaaaacagaacaaaaagattccggttgttttgaataattaaaaacggtagattggtgaaatggtagccacaacagtttgctaaactgtcgtcggaaacggcgtgtaggttcaagtcctacatctaccgccaagttatctttaatgtagcttgtaatcttactttagcagagtaaatcttcggcaagtggcggtaaccactttaccgataccccaatacttcatagctaagtgccgcaaacactggctattttaaagataatttatacatcgttagcttagttggtagagcaaggggcttttaactccaaggtcgaaggttcgaatccttcacgatgtaccaaacacgtaggtatcgcatagcggcaattgctggagactgtaaatctcctgcccttcggggcttcgttggttcgagtccaactacctgcaccaaattaaagatggattggcctagtggttgggcgacggactgttaatccgtgaacgaaaattctagcaaggttcaaatccttgatccatcgccaaatagtgcttgtagagttaatagaaacctctagaattttctagaattgtaggtatcaaatcctaccaagcaaatattttgctcctatcgtataacggctattacggttgccttgtaagcaacttatcagggttcgagtccttgtgggagcaccaatttaactctaaaggagtgtatgtgacagaaaaagagttagagaaatattttaatatcaatgttttcgatggttttgatgatattgaagatgttgaaagatattatgaagtagagttagataaggataacattgtaattctttctgccacttatgattgtgcatattatgaaggcgaatctcacgtttatttttatgatatgaaaacatctttgttttatgaagtacacgcatatcattgttcttgttatggcttagaaggtcagtgggaacctgaagaaataggtgatttggactttactattgcatatctaaacagacgtggttcatctactattttaaaataaatatcaaaagcctcttgacaaaggggctaataatatgttagagtaatattattaagcgggtatagtgttaatggtagcatatgaggtttccaccctccaggtgcaggttcaagtcctgttactcgctccaagattatttaaatggaatcgctagagaaaatttctcttttcgctcatggttttctccttcaaactctagcggttctttttaagtgatttttagttttattggagattagcctagtgggaaggcaacggcctttgaagtcgtgatgactaggttcgattcctagatctccagccaatatttacagtgcgtagcgcagttggtagcgtgggagccttggacgcttcaggtcgcaggttcgagtcctgccgcactgaccaaatttgcagagatagctgagacggattagtgctaccctgaaaaggtagaaaggatggatcgttaccatctctctgcaccaaataacaccatccaaggagtagacttggttaactgtcaatagcacattgaggcttcttacagtggtgtacttattatggctaagtggtggaatggtatacacgatacgcttagaacgtattgcccaaagggattgtgagttcgagtctcaccttagctaccaaatctattacagattgtgggggttggaacggatatctaccgtcctgttaaggatcacatgccaagacgggttataaagggttagccattgatagtgtgaagctggcgtttcgagtgctttcataaggcattgcgagaagagttcgattctcttactatcaaccaaattattacagattgtgcgggatagaggagtctggtcgtcctcgccagtttcatatgctggagatcatcggttcgaatccgattcccgcctccaataaatacctcccttctggtgtaatgattaagttacattgacacttcaaggaactcatagccgggtagatttaaaagagtatggtactcaatatggctccaaaccatagattaaggggttcgattcctcaccttgctgccaattattgtggtatcgtacagatggttagtacactcgaccgataatcgagaaacaacggttcgactccgtttaccacgaccaaactccgtgccagcggtgtcttcgaagaacaagcctagttccttctgagatggaggggtgcgactccttaacgcacatactactactactaaatacttatcaggagatattatgtatactttaaaagtaattcgcaagtttcctcaagaagaggaagtaagaatttataacactgtcccattcgtagtaaatgaagaagaattcttttattgcttagaagatgaagtgattattcaatatcattgggaaggttatgacagaccagatggtgttgtagcttctgtgattgctggtgaaagagtgttattcattcacaaaactgaatcagcatatttaatgaatgataaaggacaaactgttaaagtaattaacagaccataaagaattttataaaagcctccttttttggaggttttttattatctataaaataaagatcttacaaaacgtataaaatatgttatccttaagtaaggaggtgcatattatgcctaaattgaaaagaggtcgaggtagacctacagccgaaatgcaacagatttatgctatggatgctgcacaggcgcaagtaaaagaaatttttgctggtcgttatttagatgctatgcgttacattgcagatcttgttgtagatgaaaaggcttctgctaatattaagttgactgcttctaagatcatcaaagaacaagtagaagaatggctggaagaacattatgaatctatggaagaagaagatattcttccagaaaattctccccctcaaaaaatcgttatctaattctcctctcttgggaactttgttccccctctccttgttaattaacacccctttccgaaaggttagggggttttttatttatacctattgcttttatatatgtttttatgatatgattaatacaggaggattataaaatgagaaactatgtagctaaacacgatttcaatagggcttcttatcacagagataagaagaacagttattcgcgtaaatgggatctggaggaagagttagactatgattacagaagaacaatggaaggagattttggagaatgcacaaccgatggtagtgaagaagatagttaataattcaccaagtctccctaaagtaaaatttaaagatgatgatactgactatgttaataaacctactgaagaataaatgggttaggtattttgttcttattatagcactgtttggtggtttgtatattggtttaaacaaattacacgatgatgtgtatgcacaaggctacaacgcaggtgttgctaaacaagaacaaatattacaacaaaaccaaattaaagcaaaacagcaattcgatatcttacaagcaaaagcagattcagaaagatctaagttgaatgaaaaaattcattcattaacgaaagaaagaaatgatcttcttacacaactggataagaagagcaataacataacacaagagagaatagattatgcgaaaacatcttctggcgctatgtcttgttttagccctaatgatgacgggttgcgcatcatcaacaacagcttcccagcctctactgattgagcagtgtaaagctgtagcaacacaacaaataaaagcccctgattctgtcagtatggaaaaaccatctacccctgttttatatacccctaatcaaataaagaaaggagttacaagatcagaggtagttgataatcaaactttaaacaacgctttgtgggaaaaagataggataaaacttatcagtttacaaaactatattaaaacattacaaagtgaaggaataatttctaattaggaggagatgtggcaaggaaacctgtcaaacaatcttttgaaaatgtagatattgaagttaaagcccaacctggcaaacaaacactggctatggatcttatgcctgaagtaatgatttatggtggtgcggcaggttgtgtttcagcagaaacagaatacctaacaagagacggttggaaacaaataagtgaatatgatggtgaggatatttatcaatacaatccaagaaataaacgtcttgaattagttacaccatcttttgtagaatatgatgctaaagataatctgtattgcatcacaaacggagtaggtgtcttccaagaattaagtatggaacatcgctttgttttctacaagaagaaaaaatccaaaaaacattttgaaattcttgttggggatcttattgcactacagcaagcaggacacccattacgaggatatattgaaaatccttttggtaaacgtgttccgtttaacattcaaggtaaacctagcacatacctaaaaattcatgaggtaatgacaagtgatgataagaaatattgctttgaaactccaagcagttatgtcgtgtttagacgtggcgatcacatcttcgttactgggaatagcggcaaaagccgtctgctacttctaaaggcacttaaatacgcatataaagatccactgtttggtggtattcttttccgtaaaaatacaacagctttacgtaaatctggtggtttgtttactgaagctaaaaaactttatctaccattaaagcctcacgtaagagagcaggctatggagatggagttcagagccacaaaaggtggtacacttaaatttgaccatcttgaaaatgataacgtaactgctgaaactaaccatcaaggtacacagtattcgatggtggggtttgacgaacttacacattttacacaatatgaaatgctatatctgttagggcgtatgcgttctgaatcagaaacgtcttttatgctgtgtacttgtaaccctgatgcagatagttgggtgttaaagtgggtgcttccttatttggatgaagctggttatccacgagaagatatgtgtggcaaacagctatactttcttattgtgcaagatgaaccagtatttgctgaaacagcagaagagttgaaagaaaagtatcctgaaaactgttttatgcaaaacccaaacacaggtgaaacagtggttattgaaccacaaacatttgtgttcattggtggtactatctttgataaccctgaactaataagacttaaccctaaatacttagcttctttgaaggctcaaaccgccgttaagagagcacagcttttagatggttgttggtttgctcgtgcacaagaagagagtttctttaacagagaatggttacacgttatcaagtttaaagatttaccaaacaatcttaaatatatgcgagcgtgggataaagcagtatctgttccaacagaatcttatcgttatcctgactacacaacatctgttaaaatggctaaagactctgatggaaattattacatttttggtgattatgattatgatgctcacgatgaaggtagtaaaatttttggtagattcagaagactaccaggtgacagagataatttaattttaaaccaatgtaagattgatggagatgaagttacagttgtattgccaaaagatccttctggtgctggtttgattgaatatacagaatcagctaaaaaactaattgctgaagggtttgttgttaaaccagatgctatgcctggtaacaagaaaaaattacaacgctttatgccatttagtagtgcttgtcaaaatggttttgtttatattgtagaagaatctttccctaacaaagaaactcttgatcatttctataaagagatggagtcatttaatggagaaagatctacggcaacattaaaagatgatattccagatgctgctgcatcttgctttaatactttgtcaaaagaacagatgtttaaagcagtagcaataccttctgcaacaaatgcattaacagggtacggtaagatgggtggaagatcaagaaactctttatcttctccatatagtatcagaggaagataaatcttgacaaaactatttaaaatatgttaaagtagcattatatgtctaccccttcaatggggtagagtcatttgtccagcattagcggaggttctgagtgtctacaggtaagcgtaagtacactaaaagatcggattactggaacaaaggctcaactgaaaaagctgcactgtctccaacacaaagtgcaactaaagagaagaacttggtactttcaccagaaataggtactattggtcttaattcgattaaagcctttacgaacttcatgcaaccgtatgaaactcgcttcccagaaaacatccgaacatacaaagaaatgggtgaagaccctgacgtagctactgctcttgatgctacgtacatctttgtagatagagcattctttgattttaaaataaaatacaatgttagttcagctaagtcaagacgtgctgcaaagtttgtagactacacacttcgcaacatgaatgcaccactaagacagtatgtacgctccttgctaacatataagcaatttgggtttgcatttgcagagaaggtgtatgaacttgatgaagatccaaaaagcccgtattttggttattaccgtcttgttaaattggcgtttagaccccaggatacaattgatttggcacaacctttcacttattctgatgacggtcgcactattcttacggtaaaccaaaacattactaatggaatgtaagccactggtactaacgctactctaataggaagaaaagaaattcctatggagaaagttatttacgtagggagcaacattacagagaataatccattaggtgtaagtgtgtataagagacagatatagaagttggcgtgaaaaatctctgattcaagaatacgaagttgttggtgtttcgaaagacttaggcggtatgccagtgttgatggttccaagcgatattctcaacagggcatcactaaacccaagcggagatgaagcacaatctttacgtgttctgcaagcaaatatcgctaacttacacgctggtgaacaatcttatatggtgttaccttctgatgtttacgaaggtactgttatgcgccaatatgatcttgtattccaaggtgttgagggtagtggtaagcaattcgatacacaggctctaataaaacaacgtaaattagatatctacaacagatttggtgcaggtgttctgattatgggtgatggcttatacggtagttattttttttaaaaacacaaacaaactcttctttcacattttattgagcgtgatgtagatattattacagaagcactaaatactcaagtaattccccaacttctacgtttgaatggtattttcttatctcaagaagatatgcctaaatttgttagtgatgatatcggtgatcctgatattgaagttaatgctaaggcaatccaacaaatcgtagctgctggtgcaataccattaacgccagaagtaattaatgaattcttcgaacgtttaggtttcaattatagaatacctgatgatattgttgctgatccagataagttccaagaattccttgagacttttatgccagataagacttcaagatctggtgatggtttagcggctggtgctggtaatggaacgtcaacatctcctgctgcattagatacatcggcagcaaatttggcaaattaaaaatatttttaaaaattttttaatttaggtattgacaaataagcaaatatcctgtagactaagatttatgggatatttgtttttatgaggaaccgtatggaacttaataaagacacgctttgggaactctataaaacgttcagtggaacgaaagagaaaaagcaaacccaacaaaattccactccagaagaaacacctgctactatcgtcaaacaaaataaatttgacgaagaaaaaatgcaagtgattgaagtgatgtattgtccaccagaacacgatgacctccacggtgaacgtatgtctgaaattgaaatcagaaagatggttgacaacttcaacgcaaatattactaacgtaagtggtaatcttggtcatatcaaaaacaccgataaatttaaaccagttaaggcttgggttaatgaagtcgattgttatattggtgacgagtttgttgttgaaggaacaccactcgttaaaattcaattctatgatcctgaactgtatgaagcaagaaagaacggcgttcttaaaggtttaagtattggtgcagtaggatgtaaagtgaagaaggattaattgtggcacatacatatctagctgacgtagacttttcgggtaaagctacggaagattcttgcggagcacacattgcttacaccttcgattttcaaggtggtgctgcttctggctttaatacccctctactttttaaatctggcgacaacccagacattagcttcactaagttagaagctctagaaaaaatgggtgaagacgttactgaattacgtaaatcatatatgaaccaacttatgggatcattgtctgatgccgttcgtgaaaaatacgagtctggttgggattgggtttatgtagtcgatgccgattttgataatggcattgttattttctgttctgactacggaatgttctctactgattttaccattaacggacttcttgttgaagttggtgatgttgcaaaaccagtggtacaaacaacggactatgaagtagtagacggtgatgttttagtttccctggatttctttgataacttgattgatgatgctctaggtgatttagttaagagcgcaattaagtttgatcacgtaaaagattatttagtaaaagctcacgaagctcgtactaataaagactctgtgattgcagaggataatccagcagatcttgaatctgcaaacacaaccgatataaataaaggagatacccctttggaaaatattaacaaagaagaattcctgaaatctgctgaggtgcaagaccttattaaagcacagattgcagaagcggtagaaaaagctgctgctgaagctcgtgcagaggcagaagctaaagcacaggaagaaatcaacaaagctaaggcagaagccgaagaacttcgtaaagcagagattgctcgtatcgaagaagactataccaatgtaattaagtcttatggctatgttgaagaagacaaagttgaagcacttgttaaatacctagtagataacaaagaaattgctgaaactgttgttactgcatttgaaaaagctcgcgaagaagttgaaacagttaagaaagaatttggcaaagaagtaggtgttgatgttgaaaacaaagaacctgttgctaaatctgcttctgaactgattcgtcaaaaagctgctgaacttaaaaaagcccagaaataatctaaggagatttaattaatggcaactggaatttctttatcaaactaccgccaggaatttggacaccttgttctgggtggagtatttagttctgacctaggtcactgtgttcgtgaagtgaacctggttaaaactgcaaccatgaaaattggttctgtactgaaagctgacaacacagaagctactgctgctggtgaagctgttaaagttctgctgtggactgacgcactgttcgggatcgatgatgttgcagtaggtgacactttcaccgcagttgttggtgtacgtgacctgactctcaaccgctatgcagtttactacaagagtggtgatctgattgatgacgctggcgttgcagcactggaaactcacgatctgaaactgactgaaaaagttgttttcacttcttaatttttaataggagatttatacatgccagctattatcttagatcaggttgttgactttagcccaatgattgagctacaagaaactcctgatacacttatcgcaagtctgaacctgttcgatgttcagtaccatgctaccactgctatcgaaattggcagacagaaaaatgcagatggtctgatcccagcacgtgaacgtggtggtgagcgtaacttcctgactatggacgctcctagcgttaaagtcttccgtattccgttcttccctctggataagaacattaaggcacaggatattcaatccttccgtagcttcgctatgggtggcatcaatgataacctgcgtaccgaagcggaagttgttaaccgctatatgactcaaatcctgcgtgatgttgcaaaaactaaagaaaaaatctttgcagaagcagtaatgggtcgtgcatacaatggtgttggtggtgcagctaactctgcatacaactggtacaccgaatggggtgctacccagaaatcagtatctgtagatttcgcttctactactgtttctccggctgctaccattgagcaagaagctcgtgcatacatcatcgatcagaaacaagacggttctaccgctactcgtatcgttgctctgtgctctcgtgagttctttgcttctctggttaactctccgtttgttcgccaggcttatcaatacttccaaggtactccgaaccttctgcgtgaccgcctaagcggtaatatggacgttcaggtattcgaatggaatggtgtaacctacatcgaagatatccacggtaacatccctgctggtgaagcgtttgttctgccaatgggtatcccagatatgttccaggcgcactatgctccagcggatactccagaactggctaacactgttgctcgtgatctgtatacctttatggtatctgaacaccgcactgtacagctacaatctgaattctccctgctggcggttaacacccgtccagaactggtagttaaactgactactgcttaatccttaacgggattctaaaaagcctgccccttgcgggtgggcttttttattatgtgtcccactaacaatgagaggaaacacgattatgggtaacgctgtactgaaaacatattttagctaccatgaaatgattatggattttgcttcactatctcctgcattagatgcaggtaagacacttagtgttgctccacctatgtcattctatactacagatggtagagtagcccttggtggtaactttattcacttcttagttcgtctacgtgaagagacaggaattcaggttcatcctttcggaagtgaagaacatcctggatactatctcgttagctatgaagattatgcaccagtagaattaaaaatgcaagataaaattgaagttaaagcagtagacacaccagcaaagaaacgtgcacagcgcactaaaaagtaatgggaggtttacatgcttgtagctagtgaccttgtacctatgatccgcatattggtatttaacccttcacaagaaacacttcctgatgcaatgattgaacaaatcattcaaacgtggatagatgtgctagggaatgatgatgccaataaatgtgctgtactgtggaacagtctgatctctgtacttgaatacttgtggaatacagacgtactaaatcataatacacaaacaggtggtgctctctctagaaaagagaaagttggcgaagtacaggttgaagtaacctttggtactggacagacagaatatatttcaccttgggaaaatatctataaaggatatcttgatggtgatatgatgatacctggttgtacttctggtagaggtgtaacgagtaaagtattagttggtggtgttgatgctcgtgaaattgatcgtgtcaacagtgatcctaattcagtaaatggtttaggtggtgttggtagtgtagatcgacatacgagaaatatcaaatatgccagaaactatggccccattggttactacagaagggataaataatgaaatgtgagatcacacgtggcgatgatatgtcgttagatgaatattttagtaaaatgctggctctagataatatagaaatagatgctggttttcttactgctgttcgccatccagaatcagatctcactatccctgcaattgctgccatacaacagtttggtaatgaaacaaacaatactcctgcacgtccgtttttaacggacggtgcagtccacgccagtaaagaaatacctaagcattttgatgaagtgtttagaaattatttacttcgtggaaggggtttagctgcctttgaacctattgcaaaagtttcacgagaatctattgctaaagcgattgctctgcaacgttatagaccgctatctcctgtgactattaaaatccgtagagataaaggtaactactcttctcatattcttattgatactggacatttaattaacagtatcgaatcagaaatcaagaagggtcgttctaaaaaataacttgcaataagtctgtttttgatgtatactaaaaaggagatacaatgctattagaccaatttactctccttgatctaacaacgtatcagggtcgtaaaagaacctatgttcaagatcctgattcgccaatttccaacatgggtaatacagtagcatacgaagactttacaatagaggctgcaagtttgcaaccaatatcaggtagaacacttcaagcactgccagaaggatacagatctaaggcacaatatagcttctggacaaaaacagaaatcagaggcatccagcaaggatcagatcaattatctgaccaaatactaatagatggacaatggttttccatttattctttgaaagactggacaagaacatctttcttaatacacacacattgtgttgctattctagatgaccagaataacacctattcatattctgaggagggtggtaattttggctaatatctatgaacaaattgaattgtatgaaaatacgatattattaaatatcgctaagttcttacaaagactagtggggcttccggtttatgttatggataaaccatttgttaaaccaacaaccccatatctgacattacgtattgtatcatctgatgattcaggtggttggtcacaaaaatattcttttagtgaagatgcgttttcctatctaatggacaataagtatgaaatagaacttatggcttttagaggaagacccatgacacttttaagttatgttcttgcggcacttcgtggtgcagatgaattaaaataccagtatctttattccaaaggtattagcttcttatctgcaacaaatgttgcacaggctaacactgttctggatggagataaaactgaacaaagagcgagaatatttcttacattcaatactacgatggttattgaggatttagtaactaccgaaattgaagcaattaatatgaacattcattcgttcagagatgattacgatgatcctactccaatagatcttcctttggataagatttacattgttgctcacagaagtaaaacttattactttacgacgactgatgatggatcattaattaagtatatcccaacggataattcattggaataaagtttctaacaggagcataaatggcaacttttcgtgataaggtagtttccgtaacccttacctacggtgctacttcaattagtgaaacacagtttgatatccctctaattcttacagggcataacgttactggcaatcttgtagattatttcacttcttcagacgcacttctgcaagcaggttttggcactgccgatccagcttataaaatggcaaaactactatttgacggtctgttcgcaccagaacaagttatcgtcggtaagcgtgatgtttctaaaacgactctaactccagtagttgaagatagtgcaacttacgttatcactattaaagcaaattcaaaaagcaaggacttcaagtttgttgccgatgatactgcaactgctcaagagattgttgttggtttaacagaaatgatcaacgcagacgtagtgtataaagaatttttcactgtgtcaaacgatggtagtgttatcactgtaaccccagttgcaggtaaatacgctactatggatagttcaggattcacaactaacgtagaatatgcaaatgatatcttagaagatattgctaaaattgcagactatgaaaacagttggttctggttactatctgattctcacgcagaacaagatattatcgatctagcaggttatgtagaagagcacgataaagtgtatttcttctctacctcgcaaccaggtgttctaactaaagaagaagataacattctagaacgcttaggtgatatgggctacaataacacttgtatggcactgtggatgactaacgctgatacagtgttcccagaagctgctgtagttggttctatctgctctgcaacaccaggtactactaccctgcatggtaaaacccttgttggtatcgagattgaaaaacttggtcagacagcagaaaactttatcgttcaacagaatggtaatatttaccgtaaagaacacggtgttctgttctaccgtgatggcttcatggttagtggtttctatgttgactatgtggtacacgctctgtggttcaaagctcgcgtagaagaatctctgttcgctctattcaaacagcaatctatgcttggtagtggtgttagagcaacttctgctggtcttgctttgattcgtcaggctgttactgcaaacccaatccaagtaggtattaacaatggttctattgccaatgaggtagtaacttcagaggaaacaggacttctggtaagccttaaacctactatctatatcccatctcgtgcagatatgactgatgctcaaatcaatgcacgtttggttgatggtatggttattgaatacgtatatgctggattcttccactatgttaaagtgcaggtaaacgttctgacgaaccgcactgcaaatagccagaattccaatagctctactgtatcttcataattaaaagcagcgggggaaaccccgcttatatgaaaagtagtataaaaggagatccactttggataaaatgcttactggcgtaatggcctatgatccttctcaagtaatcctgtctttgggtggttgggaaccttggggtttcgccgcagataccaaaattgttattaacaaaactaacgatatcatcaacccatattcaggtactgatggtgacgtttccttggcgcttagtcgtaaccgtttaggtacgctaacaatgtcactgcaacgtacttccccagcaaacgaagttcttgctgcttatgcacaaacgatgtattctactcgtcaagtagcatttagcgtatatctagaagaccctcgcggatattatatcagcacaattggttggattcaaagccaaccggacgacactattggtgaaactattcaagaaaaccaatgggtaattggtcttaaagatgcaagcctacttcgttctactgtaggtgttggtgttaacgcacttaactctattagtgctctaactattcagtaacaaaaagggcagaaatgccctttatttttaaagagaggaaataatggaacaacaaaaagataatactattgcaaaatttgctcgtccagaagtaatggttgaaattgatctggatgaaggacgcagtgtaaaatttagagttctcaagtggagtccaactaaagtttttgaaaggattccagaactaggtagtgtactagctgttcctatgacaatgtataatactgctcttatgtcagcagacgaagatctagaagctcgtattgctatggcgctgatccaattattcagtggtctggaagaaaaaaacttagccgcattcttacgtaaaattttagatgaagtttacacagaagcaggtcacagtgtttccgataattttgatgaattgttttttgctcacccagaattagttgttgacttagctgcaaaagttcttgaggtgaactatgccccttttttcaaacgaggtttcggaaaactgttgacccaatttcaaggaatagagactctagcgaagagttaagtccggcaattaaatcagcaattgaaattgcctcacaaacccttagcttgacatggtatgaagtaattctttgtaaggtaattaagaatacctccgaaaccttgtcctcgttagataattatggtgtagattatctacttaaaatttatgaatatttaacatttgaagactatgtacaagatcttcacgttaaagatgcggatattaaacgtggtcaacagagaacaataagagaactggatacggctatgaaaaaattaattccagattcataagtaatacggaggattacccttgttagaaattaacacttccaagattaagaatacagtaacgtttactgtagataaagacagtttaaaaaatactaaagacgcaattaaaaaccttaaaacttttacagaatctattgaaccatctttaaatatgactaaaatgcgtcgtcagtttaaaagtatggaagagtatgctaaaagaataaggcagcaaatgtcaggtcttggcggcggtaatcctccaccaatcccaccaaccggaggttcaagtggtggtggaaaaggaggaagtggcagaggcggttctggatcttctggaggacgtaagacaccggaggaaagagccgcagaagccggccgctaaacgtgcagcacttgctaatatgaagcaagacgattttagttttaaagctatgccttttacaaaagcagacagcagaattctagaaaaatctaaaaagattgtagaagaaactgttgaactttatcgtaaaggggtaataactagccaacaaatgaacaatactttggctagacagttagaagaactacgcagatctcataaagagaagaatgcacaacttcttgatgaagagagagctagacgtagaattgcccgtctgcaagaagcagaagataaaagaagacagcgtgttcgagaaagagaaagaaaggagttcgaacgtcagcaaaggagagaaaaagaagcaagacagcgagatagacaacgtaagttatctggtgtaggtaatgctgctattgctcttaaccctgctatgtttggtgctgctcttttaggtgctggtttatatcaaggcataagcaaaatagctgaaagtatcacaactgcggcagaacgtattaatatggttagtaaaggtggtcagaacgtacaggtaaaccctaatgcaattttaacaatgcgtacttggggtgagatgaacggtgtagactctgccagcattattaaagccattgacaatattaaagacgttcgtgaacgtttaggtaatactgtactccactctgaatttgatgaaaaatcaggtaaatggaaaggtggagatagtggtattaatgaaatcatgaaccaatttggttggtcgaaagaagatgttgctaaattccagaacagacctttagactttgttcaagcacttgttaatgaaggtcaaaaaagaggaatgaactccgcgcaaattggtcgcttgatggaaaaccttggtgatgacttaatgcactaccaacgtatgtttttggataacggtaaagagtacatgaaagtcttggatatgttaaaaaattcaggagccactcttaacgatgaaaacatcaaagcagcacaagattttgttaagctaagagcacaaattagtgcagcaggagaaggttttaccaataacttacttataggatttatggatggtttaaaatctgcaccagattttgcagagaatatgaaaactttccaagaagctgctcgtggtcttggtgaaatgtctggtagtattgtaagtagccttgcaaaaattgcgaaatatttccttgatttttcaaataaggttgggccaaaaaacaatactaaagaagctgtaagagattattataatggtacgcagtatgggtacgatgcacaggttggtggtaatccttgggcttattggcctattggaagagatcaacatctacctgaaaatcaacctttaggtgactttgatagtagtttcttaactagtgccttaaacccaagtgcttctagtatcggttacaatagacctgatttaacagcatctatgctaacaccacgccaaggtgttccagtaccgttaagtgtagagaatacggttgttatcccagacaacgcattccagattaatgttattccagatggttatggttttagtaattatctagatgcgacaatgaataccagttttagtaacttctcacaaggtttaactcttcagttaagcagtggacaatcttctactggtggttaatgcataaagcctcgcttcggcggggctttttatttgtcttgacaaagagttgtttttcgtgataaaatgagtgataagggagaatgtttcttatcacattaagaggtaaaattatatggcagcaaacactccagaacaacacgttcaagcggtttataaagcggaacaagatataaattctacaaaaaacacaaataactctgcctctactgtgaaaggggagaatggtttttgtattttagcaagtgtttacaatagtgcaagtgatcaatatattcaaaactaccaagctatagtttttgatgctgttccaaatatcggtgtaaaacgtcaagcagatgttactagctatcctgtagaaaatggtgctaatgtatcggatcacgttcaagttaaaaataatactttctctttatcaggaatgattacagagacacctgtaagattaatgcgagatatgctatatagtgctggtgttaacggtactcgtatcagtcaagcaattacttacttagataaaatatttgatgaaagacagcctatcattttaataacagaacataaggtgtatgagaatgttattttgaaaggcatatcatatgaatatcaaacagaatatgcaatgcaatttgacttggaatttgaacaagtaagattagtttcttacggggaaacaaatgctattgcacttaagacaaaaccaaataagaatacaggtgttaaaaacaagaaaggtactagtccagatgctgatttggatgcaagaacagggaaagcaactggtacagaacatcttagtgatcacagtgcagatggtaaaaaataaggagaaaatttttggctatttcatcttattcaaagatcagtagaagcacatctaatagtggctacaatgcagtatttattgatcgaaatttaggttattattcttggtacttacctacagaacagtacccagaccaaacatatacggtaactctcgatggagtagattatgatatacgtttgagatggaatacaagagatcaagcgtggcaaatgcaattagggttatcaggagacaatcctagtgtaacttttaaagtaaccaatggtttagatcttctagaaccatataagtatatagaatctgtgccggatggtcaactttatttggtagatactgttaaaataaacggtagacctaattactatgacacaggtgtagataaaagatttgctttggtttatatcgacgctcttccatatcaagcatgataaaaggagtttttaaatggcagaagaaagaaattacacaaaagctcctgcacccaatctaaacagagcatacaaactgttaataggtacagctactaatactaaagaaaaaaggacaaaaaattcctctttcaaatctacagtagacttagatactaaactaggggatgctaaaaaatcaacccctaatttgtatgttattacggagcaccaaatatctttcacaataagaaaagataataataaagatcctaatcaagccgagataactatttataacctaagtgatgatactgttaattatattaacaaaggtattcgtaacaacttggctgttgctttggcagtaggttatgaaggtcaagagttaattatgatctttaagggaacggtgcaatgggtgagtgatacttttaacaatacagacagacgtacagtgttacattgtctggatggtggtattaacatctccgaagcaaggacaagccgaagttatccgaaaggtacaaaagtaagtaaggttgttaaagatttagttaaagatctaggtactacagaaggtaatattcacgtagacacagagaaaactttatcatctgcaacagctatgtgtgggaacacatcacattacttagaaagtatctgtaaaggtattgatcacaatgtgtcgatacaagatggatctgtttacgtgacaccaagatcacaaatgtctagtgcaagatgcgcatatattagtgcagaaacaggtttaattggtagtccagaacctttccacaatgatattaaaccgacacaaaaagtaactaaatcttctaagaaagctaaaaagcctacagatggtgttaagttcagatgtgaaatgaacggtgctatcttaccagaaaaaactgtttggctcaagagccataactacgatggtggttttaaggtagtatctgttgttcatacaggagatagggaaggtaaagactggacaactgaagtagagtctgtatctgtatctgcaattattaagaagggctagaaatggatgctttaaattttgtaacagcaatccgtggattaatcaacgagcaagttgcggaagtacatacatctttacctgtaagggtaattggtgtagattatgaatctaagacagtaactttagaatctattgtaaaaaacaccagatctactgaagatgaaatagattacccaacattccacgatgttccttttatggtaaatggtggtggtacaggtagaatttcatttccaattaaagcaggagatattggtgttgttgtcttttcagaaagagatccgtcgaatgctttccagacagacggagatacagccagcagcggaacattaattcaaccttgtggtttgtatccagcctgttttattcctaagatagcaacagctacagattcttctgaagaagtagactctgaaaaagttgttatctcaaataataagcaaacttacgcttcgtttgatcctaacggtaatatatctgtgtacaacacacaaggtatgaaaatagatatgacaccaaacagtatcgttcttactgatgcaggaggaggaaaacttacactgcaaggtgggactatgacatataaaggtggtactgtaaatttaaacggtttaacaatcacacctgatggtcgtatgaaagatagtggtggcattggtttacacacacatacacaccctgtacgcggtgttgaaactggtggtagcactgttacttccgacaaacccaatggaggttaacagatgggaataccatttgatttaaaacttgatggttctaatgatttagtgatggtggatggtgatttaacactaaccacaactaaaagtgaaattgcagcacagacgcttggaataacacttagaactttccgtggagaatggttcctcaattctaattttggggttccatatctgcaagagattattggtgttgccaagaagaaagagattgttgatcgcattttcttatcaactatagcaagtaatgtttatatagataatatcaattcctacacatcctcttatgatagagatgataggtattactcaatgaatgttactgttacagttggtgaacaagttgttagtgctctattcagtacacagccgtctgaagaatatatctatccagaagctggtgacgataatgcagcaatcacttgtgaagcatttgaaattgttgaatctgcaaatagactctatcgctttattaacattgttggtcttcctaaagatacttattctacttggtggaatgagtggtctaacgaggcattgattgaaaaataccttgttaacgaagccaataaaggtcttgcaaccaattacaactatgctataacagcaacaatgggagctacaaataataatggctgatttaactacaatcaaggtgtctgatctacctgtaacaacatctgtttcagacacagattattttgtaacagatcaatcaggcatcactaagaaaacatcattacgtgttcttcttgcgggtgctggtgttacacgaaatcgtctttctgcaaggggtactgttacaaataccctagctttagatattagcacggcagagtatttctctgccactttatctagtccaacttgcagtatttcatttagtaatgttccagttacaactaacattgttcaaaactttacgctatccctacgtcaaggcagtggagcaaataaagtaacgtggcctcaatctgttaaatggagttttggtcgcgctcctgttttgagttataagcagggagctacagatatttttgaatttgttagttatgataatggagctacctggataggtagtttagtgatggcaggagtgatttaatgtcaagaattaagcacagaattgacaatgtttttcaactgatcgatggacatattcagttcttagatcgtaatacaggtttaactgtagatcctacagtgcaacactatgtattaaacccacaaaacgttctagctaataacagacactttataaactggactgctcaagaagggcaaccaaacggggatgctacaacagaaggtcaatccgtgcttattcttggttgcgcttatgcatacctggcttccggcgatacaaagtatttagactctgctaaaaaatattggcaagcctatatagattacttctttggtggtcaacctatcccagatccgccagcaaagtatcgccctaactggattattaacggtaaagaaccacgtcttgcacattatcctcttacagatgatggctaccctacacacggaggctttaagggtagcttaatgacgtggactaacggtagaacagttattcctcatggtgctcctcattggggagaataccttgacaaagcatggtttgcttttaatggtaatctaggatggaactctgtaaacgctacagtatatgctgttaatgcagatggtacaacagattggtctaagaagggagatcaatgggatgttgattggatcattgatcgtctaggacgtaaagttgattgggatggaaatatcttagaagaaggttttccaacatctcaatacggaacagttcaactaaaaaatacttctgtaaatggtacatataaatttaactacgcgacttgtaaccctgttgaacacggtggttatttaatggagcgtaacactatgtggcataacagaccagttaacgttccggtagaaatgggctttcaggataatgcgtcagatgccgaaacttggtggtgtgatgctaattacctgatgtaccaaattacaggggaaagaaaatattggctatgctggcagtcttcactgttagtgtgtcaagattattcaaacattgatatgtttgataaattcttccgtaagtctacatatgcaactattccgtttacagatggcatctcttacgattattcgtatccatctacagcaatacctaaatattcaagagatactttaggttatattgttattagacaagatgttgctgctcaaacaacattagaacagcaatctatttggtttaaagttgatcagaactctaagttacgagttcagttccaaggtgtagatgacgcaggacatggtattcttttccgtccagaattggagctaagtaagaccaaagatgaaaataacacagtaacttaccgttgtggcttaccactgggtacagctagtatgacaagcatggatattccattatccagctttatgagaagtacccctccgagtggtggaacatatattatcgcagatccgcgaattattgttgactggggtgacaatactgtggtacaatttaagtatgtaacaggtattgctggaactaataatgaccagattgttaccgcatcaatggatacggatggtggtatcactgttggtttttggttaactcctacatcaaaagctaatgttaagtctattacatatagaacatatgaagatgactttaacatgactataacggatgctcaaggttggagatggtgggctatgctgcctaaaacacaaggagcatggagtacgaagactttatcagcttctgattttaagttaagtgcttaccagcctaatcatccagacacagatcctaaaccttcagcaataaatcttactgcggtagatcaggtaaatttagttcttgatacggctcctgtcaatggtttaacaggaacaatagatttctattgtattaacgatgtacctgaaagatattcgtcatcttctggtgatgattatactatgtacttccgtatcactgtacaggcttcaagtcctcatactgctaagttaggtgattgtactattattgactataaattaaatagtcttaattacactccaggaataattccattctctaatatcagtgacccaaatactgcattgtatgatggctggcgtggtattccatatccaggataccagtatccttccttatactgtttcgcaggtagggatattgattggacacgtttaaacaacagtattgatttcttgtatgatgctcaaatgtggttttataacacatttgatcctgtgatgcctgggcctatggcacaagcgtatgtgtgggatcgttgggatgcaagaaaatacggtgaacctaatacgtttacaatgaaacactggaatgaaaaagcgtgggatggttatgaagctcgtgcattctactgtgcttgtcatgctgtatacgaacttgtacaaagaggagaaacacctcctgaaaaactagtaactgtttgtaaaaattggatcaactaccttaaatggttccaagacaataatgatggaagaacaccaactatctttaacccagatggtacagttcttgcgcctatagatgactttactagtcatatgtctgcactgtttatggcgggttgttcaatcatgggcttggcaggttatgattcacaaattccaaacattggtattgtagcagacagatgttttgatctgattcagcaaaactatattgtgctttcccctaaccatccgatgaatggttcctggagtgttgcaccacgcccagattcagataacggaatgttctttggtttccatgctggagaattattacgtggttttggtttatatgccttgtatcgtaaactaaaccctcaaaacgctttaccaattttggataatagtaacataccaacactaactgttctaactatgaatgatattagtgttgatgtaaccaaataaggaaaataatgaaacaggctatttttactgtaactcgaaatacgagagtaaatgccagttcattcagctataagaccgtcgatggaacggcggtcgctggtagagattatgtagctaaacagggaacagtaacgttcccttctgatgcagattctgctactgtagtggttgatgtatatgaacgtccggcaaactctttagatctttattttactcttgagattactagcataagtcaaaataacatgatgattaatgaagaaattcgttgtgttattacgactaatcaatcgaatacaaccccgctaacttggcctgttgtgaagtctagaatgtttgatcctaagttttggacaatagattctcaatcaacagaaagttgttctattatctctaatggtgattctttcacagccagaatggttaataggacagtggctggtcttgctgggattatttggtggacttacgataaatatgatcacaaaggattaggctaccaagaacattctgatttaagtaaagaaaaactttggtttaaaatggaacttagtcaaggtgttcctggattaaaagaagaaaaattaatgccatccttaacagtgacactgaaggatgaaacagttcattatgtatctctaaacttttatgcagaagaagtttcagaggacggtaaaacagcaataatcaaattagatttctcaaatttaaaatctgggccagaaaatgatattgttgttgacactacacagatagataacatgttcttctccttgatttccgcaaggtatcaagaaattgaagatgttattcctgtagataatgtggatctttcttttaagtttaccatactggaacctgatacgggttatagtatgatgaatatgggtaatttaaatgttccagcacacaccataagaatgtgtacatcttatgatgatatgtataaccttaccccagagcgagttatttctaacacctacagattaggttatagggatatgattaaccactataatggtatgtcacactattatcaatttagttgggatgctggctctaataaatgggctttgaacagaacagaatatttaaacccagcaacagaagcctggtttgataatttccacgctaatgcaaaagctatgggttacacagtaatgaactccttaagttttgaacttatgagtacagtgtgtcctgtagaatgggtacaacatacttggaatgatgatctggctgctacaggttatgagccaccaagctatgttttatctccttcaattgatgaagggatgaattatttacaaggtgtaataaataagatagcttctatatccgctgccaatgatcttcctgttattattcaggttggtgaaccgtggtggtggtataacacagctaccaatctaccgtgtatttatgattatacaaccaaagttgcatttaataatgaaactggattatatgcacaagatgttggtacagttaagaattataaaactggtacaccatatgatgaatattatgcattcctatctaaaacattaggactacgtgttgctaagtttgcaacggatactagattagcatatcctggagcgaaagttacattattaccatttgtgccatccattttaggtaatggtatgatggagtttgttaacttccctaaagattattatatcccagaaaactttgacttttattgttcagaatgttatgactggttgttggaaggtcagatggaaagatctttcgacgctatcaaaatacctaatgagcaactaggttttagttatgataagatacattatcttgcagggtttgttccagatgcaactctagcaccattatatggctttgatcctgaatcagactacagaacatatttgtggaaaatgatcataggtaatatcgtattgaacgaccagaagtttgttggtttgtatcaatacatatgggcttacccacaaataatggaagattcattaactgttcttaattcaaaatcccaagttttttatatgggtaacgtacctctgaatgtctttttacaagatacagtatatgtttcttcttaaggatctctagtatgagaaaatttttaataggtatgttttgtacatatcctgataataaagtcagttctactaaagtttggaatgctattggtatgattgttatgtccagtatgtttatttatttgggaattgataaagaaattcctgaatggatgggctgggcttttgtttttatgatcacaccatccagactaatgaagaatttaatagatttacgttggggcagatcacctgcccctgataaggaggataactaatggcagattatggtttaacagatgctggttttgtcattccaacgtttgatgatattttaaataattatatgacagcattgaaaaacactttcggtgcagatacagctacatctgaagatactgtctttggtcaactgtttcgtattattgcatatacagattacactctttgggaaggtatgcaaggtgtttacaatacccaaaccttagatggtgcagaaggtatttaccttgatgaaattttctctaaaagaggtttttatcgtaaggcagcttctgctggtagtggttatgcttatgttaaatctaacaataaggcagcttggacttatgaactaagcaccgatgtttattttaatgccgataatgatttgacatattacgtcagtgcaccaacaatgttgaatgctaagattggagcatataccatttctaaagcaaacgcaacagcttctggtgaaacttctattactttctacattcaaagtgctattgatggtggtcttaacagtaaaacactaagtcctagcaatacaaactttattttagatctcacgaatttcattaaagctaacgtatcaacaacagatcgtgctttagtatggaatgatgctagtaatgtttacatgggttataatccagaagataatgttaacccaataggtctagtaacaccagtgaaattttatgcatctattgcaattggtacaaaatggagtgaaattccagttacgtgttcagacgttggttataatccagtaggtacagaaagtatcacaggtatttcttcaacgtttacaggctttttagatacaggtaacttctatccattctctccaggtacagatgttgaaacagatgcagaattccgttctcgtttcaatgataatatggatgaagctaatgctgctactcgtgctgctattgttaaagctctattactgacagatggtgtgacaaaggttaagatttatgataaccctacactacacgatcaggaacatgctccagctatgacattccagactattgtgtatggcggtacagcagaagaagttgcacaggttatttataatactaagcctattaacaccttaacctatggtacaacagcaattactatcgtaacagaagatggcggtcaagaagtaattcgtttttctcctggtgacaatgctgaatattcacttaaactggtgtatcaaactggcaatggtagtgtgctaagtacaacagaaagggaaaatattgtttctgctcttgcaaacttacaggcttattttgagctaggatcaacagtaactaacgatcagataaaaggtgtaatttattctgcacttgcgttcggacgcttgacttctctccgtgtttatgttaaacttaatactgaggatgacagtaaatataatgagggagatatcactccagcgtacaatgttgtaccatcctttgaccttgataatatttcctacgagtacggagtctaaaaatggcagtgagtgttgaccatgtgacaacgtgggatagtatcaatgaagatgttaaagacctactgattgaagattttaaatcttctccgaacattgtcaaactactctatatcatttctagcgaaaaacaaaagatagatcaggcaatgatctatcttgccaaacaccgcttaatctctactgcaactggtaagtatttagatcttattggtgaagagatgggaatggaaagaaatggtgctacagatgaagagtatcgtacaatattaaaaatcagggcttatcgtgttgcgtcttctggtacgcgagatgatatcattgatatgttcgctcgttttacaggaacagaaaaagaaacgatcaatacatacgttggattaaataaaacattcgacgtattcttttataatttgtgtctacaatccgatcaggcagtagcacagttacttaacgttttcccgatcctaagtagttatcgcttaggtgcgaaagcgggtgcagcctttggtttcacttcctattatgccacaactccacctcatggtataggtggtttaggttctctttacacagaggctgaaggagatgatacagggcgaatgactatgctgatagctcaaatagaataaggagttactcttaatggcaaagccacaatactaccctgactgggcgacacaaacagtaaccctcccaggaacgggaaacacaaacaagattagaccaaaagaaaccatccgtaatgttggtatggactttggtcagattatgacttgtgaagaaatgaactggatcttaaacaatattgggtcttggattcgctatatgcaagatgaattcttcccaacattgcctactacatatcttcctatagtcggtactaaaattacaatggcaggtgatgctacaggtgaagttacatggaatggtaatgctgctgtaacattatctattcaagtcgtagataacagccataatcacttatcagctaacattacagacgcaacatcgaaccaagttgtaggaaatgtccttgttaagcgtgataatggtggtgctatctatgcaggtgatatttacacttgtggtacaggtgctacagatcctgcaacattattttttagaaactacaacggacaaacagtaggtaatatgtcctctgaaccaggtgcaggtggtcaactctatatttatagaatgaacccatcgactggaggaacatcttgtgcagtccgtttatatgatgcaggttatgttttaatagacaatcctcgttctaattctggtcaagatactggcaatggtaatgctcttgtaagattagattatcttaactccagactaaactcattgcaaagcacactgcaaaataatattaacaacgttaatagtaacttgcaaggccaaattaatagcattaacaatagagtttcttctgttgtgtctgctatccgtcttggaacacgtatccaagctggtgtgtctgagtctcgtttctatgctggtcacgtgatcacaggttggggttttggtgataagaaagaacttcgtggtgcttggtattggtcagccccgctacaatattatattaatggtagctggataacagtaaccaacgtttcgtaaggagagtctatgaaaaaagacgttatttttacaggttttgaattgtatgaaccagaattaacagaagaaaatattctttatctttctgttggtggtggttttttgcaagacaaagatggtaacgactggtatcagcttcaaaaaactttgatggtagaatatcccgacgcttattttattaccttagatgataataatattgtacgtggtgctactaaagatgttactacctatttccctgccggacaatctattttagttacatataatgtaccagataaaatagaagatgaaagtaatattggctcttggcaatatgttgaaggtaagtttgttcctcacaataatcttgctattgaagatgctactcttaagttagaaaaggagctaacttgggctacgaatcaagtgtctgcgattcaagatttagaggaattacaaggtttatctgaagaacaaaaagattggttaggaaaagttaaactctatcgtgcaacattaattcaaattaacgttgaagatgcacctaatataacttggcctacaagacctaagaaataggggcaatgtatggagctaacagaagtatgggatatcgctaaagaggcgattatccctcttattggcgtaatctgggtggtcttcaaacagaagatagatgatatggcaagtgatttggataaaatggaagacaaataccgcgaactagaaaagaagttggtgtttgttgaatccacttatgctaccaaagcagaacttgctcaaatgcttaaccagatcaactctacattaatggcaaataatactgccttagaacagaagattgaaaaaataatggatttaaaaaatgctcctgttcaattaatgttagaggagattacgaagcgcacacaaagtaaggacaaaaattaatggcgaattttccaacatatcctgctacgacactagaacaaggtgttgatctggttatattctcgtctaaccagatgcatgatgttattaatggggatgctacagcaactgtagaaaccgaaacaggtttaatacctacactctgcgtaaagcacttgttgataacttcttctttaagagtcctgttgcttggtcagcaggatcaactgaaactgtatttaaccagttacgttattttgaaaacggtatcttgagtggatactattatgccccatctgccactactgctaaccctgtacctatgcagggtacacctgtaggagatagtaactggactctgtacgctcttaaaactgaacagttagcttcagatgtgtatccttggtattttaaaggtgctacaggatatgaaacagaaatcagtcctccttatatctttgataatgctattgtcaccattaacggtgtaattcagattcaaggtgaagcatttactatcaaagatagtaaaattattctggcagaaccattaggtttagatccgtctactggtctacctaacaaattgtttgcttttattggtaaaacaacagcctctacttcttacgtagagaaaaaccttttgtcatctaccactggtgcagcaatggttggtcttccatctggaggcaacctgttacaagctcaatactttgtaacgcctgagcagtttggtgcaattggtgatggagttaccgatgatacccaagcaattttaaaaaccattactttcgctaacacgaataacattcaagtacgtgcagataagaattatagattcacaagctcaattgctatgtctggtattcgttggtatggtggtacattcactggtaacggtggaacaatgatttctactgtgtcctgttggatggaaaacgttcgctttgaaaaatgttatgttaagatgttaggtggtgattgccgattctatcgtaatatcttctccaacgcaacatctacagcagcattcttaatgcaagcaatgacaagtgaaggtacgttggacttcagttacaacgaaatgtatggttgtaaatatgcgatcctgcaacaaggtactggagaagtaatgacctacgggcgttactctaacaactacattcatgatattaaaggtgatgctattgaacttaacgtagttcaaaaacactacactgaaggtttggttatcgagaataaccacattgctaacgtagatgcttctggacaaggggcaaactggggtattggtattggtgtagcaggcagtggcccatatggtgttgatgttcctgattcacaatatgtacgtaatttcagtatcgttgggaatagggtttacaattgccgtcaatgtttacacgttgaaatgggtaaaaacttcacaatacgtgataatgaagtttatcctaacacagcagtttcaacaggtacaggtttaactacttgtggtgttgcattatacggatgccaagattttgaagttgatggtttaactggttatctgcttaatgatccgtctgtttcaacacgcatggtctttattgactggggtgttaacagtggaagatatgcggggccaccaattaactttacaattaagaatttggatattccagaatcttcaattgagattgcaacatctggatcagatgactgggaaaactctacaattgttagtaatatcaattgtaatgtttttaaatggcgtgggctaccatctagctctacctttaataatattcgttgccgtagtattgactttattggtcaacacggaagcggagaaggaagtggtggcggtttctatactcgcagccaattcacgtatatgaagtgggtaggatgtacagcacttagcggagatgaaacaacagtttcttttgctaaaatctacactgatcgttgcgatcaggttggaaataactttggtgttccaactgctgttgatggaacaggtcatcgtgggccagttttaactactatctctgaacaatattttacagcttatgatgaattcccaggtgggcgtgaattccctactggaacagttattcattgtgcaagcggtaaaaaacatgttgttacagtaggtggtgctttctttagtgccaacgagaaaataaaagcaactgttacaggtcaaacctatctacagtctaatgctttaaactgggctagtaatggctacgctaaagcagcaggtactaagattgttattccaggtgcaggtgcaaatggcggcgatcttgtgacaactatagcacgtgctacatatgtgacaaatagtttgtacacaatagatattgcagatccaattgtaacacctacagcagagaatacacaaattaaagctctgaatcctgttacttttgttactgtcaacaatgcttaattaaaaaggggcgaaagcccctttataaaaggagtagtaaagtgattttaacacgtccaaatagtgccattgcagacatggtagagtctcgctatagaaagcgtagaagttttgcaagtggttttaccttaagagatgctcgtgaagcattgctctttgaaactgacggtaactactatcagtggaaaggttctctacctaaagttgtacctgctaactctactcctacatctactggagggatttcagatacagcttggaaaaatgtgggtaatgcagatgacattgctcaaatagaatcagaattagatgctattgaagctgaaattgaagatcttagagaatccattccagaagctggtaaatcagcttaccagattgccgtagacaatggtttccaaggtactgagacagagtggttggcttctttaaaaggtgatccaggtgctccattaaagctgctagggacactatctaataccaaccaattacctacaactggaaacaatgcaggagatgcatggattgtaggcgagaatatgtatgcttgggatggtactgcttggagaaaagtaaactcacaggggccagaaggtaaatcagcttatcaagtttggcttgcagcaggaaaccaaggtacagaactagattatcttgcttcaattaaaggtgataaaggggaacctggcccagaggggccacaaggtgtaccaggtaataatgctaatggttttgattaccaaggtgcagctaattccgtttcagatcttccttctgcatctcctggaaacacatctcaagcatggagtattggtacatatctatacgtgtcaaacggtgtagaatggatcaatatgggcgctatagtggggccaaaaggagataaaggcgacaaaggagataagggtaacactggtgattctgcttatcaagtctggttaaatgctggtaacgttggtactattgacgaatatattgcctctctgaaaggagaaaaaggtgataagggagacaagggtgatcaaggtgagcagggtatacaaggcttgacggggccaactggtgcagggttgacaattattgatattctgactgacacttctgaactaccacaaactggagaagatggtgatggttatctgatcaataatgaactttgggtttggttgcaaggagccacacagtggacaaatgttggtcgtttagctggtactccaatcactgcaaaaggacacgttgcgtctgcaagtgcacttcctcctacagccaattacggtgatgcttatctgacggaagatacaggtcatctttacatttacacctatgatgaacaaactcaaactgctgaatatgtagatatgggtagtttgaaaggtgataagggtgaaaaaggtgacgctggtactaacggtacagacggtgcaacttggattgttaaaacaacagatccaatctctagtgatggtaaacaaggtgattatgcctttaatatctccactggcgaggtgttcttaaaaacatctgcaactgcctggacttctcaaggtacactgcctagcatcacagatgcacctagtgacggtaagatctatgctcgtaaagatggagcatgggaagaactcactagttctgtagatggtcaagatatagttccaacaaaagtaacaactaattttatagaggttacagcatacaccaacaactctgttacaggtgactggacacctccaggaacacataacatgaatgtgttgaatcttactggtaactctactataaaagcatggcctggtgtcgaagatagcacaaaacctaaaccattctctgcaatagtttatcttatccaagatgccactggaggtcgtactgttactttagatccatcttacaaagtaattggttctagtgatattaatacagatcctaacggagtaacaatactacaactaacatattgtggtgttggcgattacgtggatgctattgttgctaaacgcacataatcaaagccccttcgggggcttattatttaaggagattaaatgtatcctattcctttatttatgtcaacaacatcagcttcagtagtaacagctacatctataaccacttcatctattggtattgcaatagttggtagtaaaaagcaactgacatacacagtttcaccggaagatggtgcgttatttgatatagctttttcatcttcagataataccaaaatggttatagataatagtggtatgatggagtttgttgccgaaggtggttttgatgcaataatgacagctaaaaataatttaggtgctgtcttaactgatcaatctggtggttatgcttcagaattaagcgtgtacactgaaagtctatcagctatggatgtaggcactactcaacagttggttgctacaatcagtccagaaggtgctaaagatcttccagacatggtaattacgtacaccacaacagatccagaagtagctactgtaagccctacaggattaataactgctcttaaagatggtaattgccgtataggttgtactgcaacttatcaaggaacagtggtggcctctgatagttcttatttaggtgttaatgctattcctgttatttctaatgtaacagccgtggcaaacagctatggagacgttcgtgttgcttgggatgtagctgatccgctagatggtgatacttatactgtagaagtattagatttaagtaataatagtgttcagtggactacaacaaccacgaatacttacgcttactttgatatctctgactctgttcctctttatgggtttgctccaacataccttaaaattagcgttaagagcaccaaagcagcagccgttatctttaataactcaatagctacagatgattcgttcattaaagaagttattgtttttgctggacaagataacgtaaatgcacactttacagaactatctggtgcaaataaagcagcaatgagtagcacaacagcccgtaatgcatatgctacgcaacgtggtttagcaaatgctgaagttcttccgttaaatacagcttctggatcatcagcagcagataaatatgctgacgataaagctggaacaggtacaccagacaactactggtatgatctggataacacagcagatgggccatgcttaactaactttatcactaaagtcacaccttatgcaagtaaggttaaagccattatttggggacaaggtgaaaatgatgctgtatcagcatcttcaactgttgcaggtagatacagtaacactacacgttaccatgatgctacgatagctatctttgataagatgcgtacaatagttcctgcttctcaagcaaaaattgtttggcagatcctgggacgttcttatttatatggtgtagaagttaatggtgtggattggcagaaatacagaaatgtacaaagaaccatctctacagcacgtgatgatgttatcattggttcttgggtagatggtgctgaacgttacagtggttatgtttatgaagaaggtattgatggtcgtatccattatatttcttctgtataccagacagcagctacaaaacttgctaaatcagcagcagacggtacagacctaacatcaacgtcacctgtttgggttgatatggctgttccaactggagcaacagctacttcccaatctaatcaagatacaattttagcatgggatgctcaaggctatagtaaacactacttccgtaatattaacgtcttaacagcatctgtattaactgaacaaacacttaatacgaacagttatacgtttacctatgcagatcaagtagaacaatatggttttgcagcaggaactactatatttgatgttgcatattatgacgaagcaaatgatgtgttatctcctttagtacgttttaatgttaacgttacagcaggaaccgtagaagataaacctgtcgtgatggattatgatttgacgcaagaaactcttccatcagatgttaaggttaatggtgggaactcttttgctcgtgcttctggagatacacttgtagccactaacaccttggttgctccgttggagtatgttggtactacccctgtaggtagacgtgtaacagctaacacagctacacaaatttttgtcaacaacgccttaacaagtgcaagcccgtgggtaaagaccaacttaactgttgcagcttcatctgataactctccggctggaactactgctaatgtattcaaattaactccgactacaacctctggtagtcatatcttaactgcaacatatactaacgcgtacaacatatctgccggacgtaactggtctgcctctgttttcttgaaagcgaacgggattactaaggccaaactaagattaaaagcaggaactgaagttaatgagggtacttttgatttagcagcaggtacattcacaggaagtgaagctaatattatatctatgggcaacggttggtatcgtgctattctgcataaaacagggatagccaaacagtcctccataagttttgaaataattgccttggatgcaactggtgcggagattttcgctggagatggtactagtaaccttgcagtttggttgccacagcttgaaggtgcttctacaggagaaacatcaaaagctggatcgccttatgtctgcacatatcctggaaatttaggaggagtatccttcactataccaaggaacggacatactggtgtggatgtttactattccaacggagacgttgttcgtgacgtattctctggtacagctactacttggatgttgtcattcaacgccgcaagtgcggattggggatcgaaattcatttctggtttgaaatattacgactaataaaaaaggagcctattggctccttttcttttatcttaatcagtgaaaattacgcttacatcttctttagaaaagagtttatgatcttcaccttttgtctcaagagtttcatacaggttaagaagttctgaaacatctttctctaccagtttcttcaatgttgcaattttctgtttgcgactcttaatacgttcagctacaaccttacgttggtatccagcagtacgataacctgagaaagttacaccagtgagacttgcagttacaggatcgtaatgacgttcaatctgaaatttattaaaaggtacagcgtcatcacgaataatcttcccgccattacttacttgacgaagaccagtaacttgttctagtcgtgccatagaaatctttggagacagaccagagtccaggttcataccattgttaatcagtgctttcagggtgattttgctgttcagtgtactcatttagtcgttcctccgcttgcttaaaaatatttacatcggcttcacagcctaagtattctctacctgttaaaagtgccgcaacttgtgttgttgcacttccagagaagaagtctaagactacatctccttcgttggtgtgtatattaataaggtcacaaaacaaagtcaagtgtttttgtgttggatgaaaacgatctgctccttgatagataggatactcaaacacacccttatggtaggaagcattgaaggttggcttagaacctttaacacaaacaatagccatttctttagcgttactaaggtagttaacaccactgttgatgggtacagggtttgttttaatccattcaatagtacggaacatacgaaaaccaagcggttcaaggatttcacgtagttcctggatcttccagatatcataccaaactatgcaagtaccaccttttctaagcaccctgtaggcttctttgaatacttctttaaagtaaggaatatctacaacatcccaatcaccaaagttgtaagatacacggaatctatccgtatcttttccagtcggctctccagattgaaaatttgtgtcacgagaaatagcatatggtgggtcagtaagaatcaaatctacactattgctttcgagggtttgcaggtagtttaatgcagtgttgtttacaaattcgctcattatatctccttcaaagagaaggagccgttaggctccttatattcacacaatacttaactattagaaacagtgcaggaagtttcgaccatactgcaaaccaataggagcaaatgggatatcatcatcgaaatcttgaacaacaggttctggttctttcgatgctggctctttcttctctacttttttagtttctttcttaacttcttgtactggggtagacattccacggatagcagcagctactttatcagacaaagcaagaacttcacgagcagcttcaataatctcttctgccgttacagttttacctgtatgatcacgacaagcgttaagaattgcgtgtccaactgaagcaccaagatcatagtcagtcacatcaacgccacgatctttagcaatttctgctttcagagtaacagttgcagattgtaccacaccagccaagtcgcaaacatcccttttcacaccacacggagaagcgccacaacaccctttacagcgtgtcctgtttcaatccctacggtatcacgttttttgtagttaggcttgctaccttcgttattagatgggttatttccaccttttgaagaagattgcgcttgctgaacaccttctgttgaaagaacagtgattttacctttagaggagttgtagtatgttttgccattccattcggaaggtttaacatccatagttacttctacacctttttcgatagtaatccacttatcaccatctttaacttgcaggttttcatgttctggatgcagtttaacttcacctaggctaacccaaacacctttatcatcagcaccagcacctttctctttaataagcagagatgctttgtgagttgattcaattttcttatctggctgacctgcaaccttaatataagagactttcatttcatcaaacttatctagtttgacatattcaacgataccttcagcccagaatgcttcttttttagtacgacggtcgatttcagaattaattactggcataaattctcctctataattacattactttaacacaaaactctcgtaaaagagtagcgtcagtttcttccaacaggtatttaccaagaccaataccaaatcctatttcaccactttcgaaatggaggatttgtatcttttctccaccaaggttaattacttttgcttttccaggattatccaaaacatctcgtattgtatcctgtagtagcattagttcacgttttgtgatagtggtttcagatatctctttgttttctactctcactgttaaacgattgtatccaccaaagagacatagtatttgaataaaaaaggtattatcttgaggttcaacatcttttttagttagctcaagacgattagtttctctactgtagaacgtctcgactaagattttataaaaagattatctgtcattcaagtcctcataataacacataattataatgtttgtcaacacttaaattttaaattcttcattgttaaatgaatccagtgtacgtacttctggttctttgggaatgaaaacgtcttttacaaaacggaacatagggaaacgttctgccattttacggacgtgtgcttctttacctgtgtatcggtgattaatagtacaaatattagttttcagtgcaaattcaaaatctggatgatatacataattttgaccatcccagtaacacaggcaaatagctacatcaaatttccatacgatttcactgcgtacaccttcttccatgaccataaagttaaacttaagatctttatagtatgcttcaaatacccatttcaaatgtggtagttcggcataggtgtgttctgtttgcttagtaagttgtttaacattacgtgcaccaacacccaacatcaaaaatttctctactaatacgagtgtattgtggttaggcatacgcaagtaaatgtcaatatcttgcgcaggtttctctaatcgccagtcacgtacagcgccgccagctacaattgcaaacggatctaccagttggcacatacgtaatacttctaaagctcgtactttttgatcttcaatattcatatttcctcctatctcttgcgttctttgagttgttctaaatgttcaatcatataattataaaatggtttaaaactgtggaacaacattgacaattacagattgtcccccataaaaactcctttaaaatcaaagagttttaacccataagtggcccatgagttaccaacttcgtaaccagcagtaagaggtacattaagattgtaatactcaccagctttattaacagcgatagatgctaattctccagcacgactgtaggctgtaaaccaaccacctttaggagattcatgtacgttagcccaaatcttgccagtacgtttctcttcctcttctttccaggtattaactttatccaaacattctttatcaattttcttttgttcttctggatcatcaacttgagtccaacctaaagattctttagagaaccatttaaaatgcaccagatcacgagttacttcaagctgtgcttcatcgtgatatgcaatcatttgttgaacgaatgacttatttttccagtcatcaacaaaaaagtcaacagctaatccttcttcttcgataagatcgtcgtagataaccattgctctttttgcacaaataacaccaccactctggaacagagagttaagtattgcgtgtgcagatcgtgtgggtactttcctaccatcaataccaagaatgtatttcttacctgttttaacccaaaaatcatgcagacgttctttaagaagcgcaagaggttttgcagcttcccagaaagcatcgtatacaagctgtcctgtatacatatcactacctatggtttttgctacttttgcagcttgagcaccataagtaataccatacttaacagatttagcagggcttcgttcaaacttacgaccaatagtatcagaaatacgtcgagccatcattgtatgaacatcattaggtttttccaacaatagagcattacaatattcgtgtggttcctgctcgtaccgccaacagtagtgtgattctatttttgcctcaagagaatcaaagtcataaccaatttggaagtattttggaacttctacaccaaataagttacgcatttcatatccgtacagagatgttacacgtgggatatttgctactaacctatgtttcatacgagatgtagctgcatcacacgttgcagcaggagttggtatacgaccatcagcccttactgctgccagataacccttatcgtaatcctcttcatcttcttcccaatcagcaccaccccctagaatagagttcctacggtgtttatacgtaagatactgcacaatctgcgtagcataaggaaacttttcacctagtgcttccaagttaggacaaatatctttctcttgcccttttgtaaaggaagggttagtaagcactttaacaccacgacctttagctttagcaatacgatctcttagtttccattctaaagtttctggtgtgcactccagatgatcacatctgtcctggcagaagttagatgctaacgtttgatcaacatagtcacgaatagctttctccatctgtgcttcatctttcttaatcttagtgccagatttaagagtgatatctttatctttatattcagatggactccaacctaaaccaactaaccagtttttaatatgtgtcgtgtcgtctaaagtagcaggtactgtaggatcacaaataggttcttctgctggaatagggagtttaaactctttacctaatgcaaataaccaccaaccatcttctttttgtacaagttcaccagaatgtttctctgcaaactttatcatgttacttgaaggttcaccattctttttaaactgtagtttaggtggaatgaatgatttcaaataacctttagtagcaggtttaggaggtagtacaggttctgcctctaaacgacatgcttccattcgagcatccagatcacgaatattatcttctgcttgtttcatattgaaagcaaagccacggtgctcttgacgtgtaataatatcagctacacgttgttctaagttaaatggttcagaccacttattataatcaccccactcttccatcaaataacggaacactgcggtgttagctttgttatcgtaaatacagtaatacagcatatctgctgcaaatgttttaaatctttcagcttcaggaatgttttttctaaaatcaattttaacatcccctccagctttcttagataactctgccagactatgaccaccgaagcgatcagggtttagtgtcttacttaagatcatagtatcacaaatttcaatgttactattaccccaagtattgtacttaatactgtagttgagtttaaaaaataatttaattgccagtaagtcgaagttaatgatgttgtgtccaactactttggtaattttatagtttgaattacctttaaatttacctgttccgtttacaaaatcaggaaaatctttaagagggaaatgggtatattctaaatgctcatattcctccagtcggtattcatactttccgtcagtctcaacatacggacgaccatcgaaaagatatttatcaccatcatggaaagcaataatctctccagtatcatgactttcgcacacaatacagtgcattgcaaaactatcttttaaacgatatggacttgccaagtaatctacactttcgtcattaagcaagttgttactttcaatgtcgaaagtaaaagctcccattctccctccttaaaatatttctaaagtcttaatttgttaatactgtaccacaaattaattgttttgtaaaggggctttcgccccttcttgttattaattgtcagcacttagttgtactttaataaggcaattagggacaccattggtatttctcaagcctacacgttcgattttaacagtgcctgtcaaaccattaaaagtggaaacaatgttattaatgttttcatccttactagtgatatcaagaacaactttatcactaacatttttcaacatacgatctacaagctctcccacaaaaccactggtagtttgaatgagaaggtatagacaaccatcctcaaaccacaaatgttcaccataagcataaccgtatggttctaattctgatccgtcttgaaatttaaacttagcaatagttttcgtataatcatacgctaaagcagaagggcataccccataaaggatattttcattgtctttcatatttttctccttaataagaaccagcagaaatattttctgggttacttgtgtattgatcgtaatcgtgaagtgtagctgttttaatctcatagaagaaactacctgctgcaccagtctctgagaactcacggttctttagaatgtagcaatatgtgcggttacgttccataggatcttcagcttgtttatcacgctccagcgcaattgtgataccagcacctttagcaaggaagctactacccattgcatcatcttctacaatatgttcattactattgttagaagactttttaacgtgtgaaattacaacaatggttattgcatactctttcataatgcgtttcagccacgtcgcaagttcctcttgttgtgacacgtccataccagaaagcaaatcagaataagggtcgataacaagaatggttactccgaaataaataatcatttccagaaccttctctttaatcacatctacgttagctccacgatcatcacaaacatagaaacgtggtgttccatcttcccgttcgtaaaaatcacgaatcttttcttcattatcttttaaaatcttttccttctcttctttcgttttacggtgaagagggatatgcaagaatgaagacagtaagttacgagaatacttcttatacgttgcctccaaagataaaataccaagagtatgttctgggtgtgcaagaataatgtgtttcgtaatctcgttaaccaacagtgtcttaccgatacttgtttttgcaagtataacagtaatttcttcttctaccaagcctccacctaacatattagaagcaacacgcatgaatggaggaagggtaatcattttagcttccaggcattccaaggctgcttcatacagtacgttagaagcgtaaacaccagcaggtgtgtatagtttagctttgaaaaagcgatcaataaaatgatcaatttttccttctactagtgcctggttaggatctttaacatcagttagttccatcacgtaaactttattacgtggtaagattttaacacatttctcaactgctgcacgtccagcttcatcattatccatacatagaacaatctttttaaattgatctaagaatttataacgatgttgaagctgcttatgcagagatgtttcgccacaagtaccagatactacagcaggaacaggatatttaccacccttgttataatcttttagcatctgtgttgcagccagcatatcgtgttcaccaccaacgattagaatagtaccgctgtggttacgatatttaaactccccaaaaagatcacaatcctttcctgtttcaccgataggatgtgagaaatcttttggatcgatacgttgtttatacccagcaatattgtaatctttagttgtagggtatagtgttgaaattacttcgccagtagcttcatcgtacatatagcgtacaccgaaaggcttagagatatcttcacgaataccgcgataaccttttggattagttccagtgctggcttttagtttatcatgtacttctggattaaactcactacccaagatatcctcctcttcaatttcttcgccgtgtgcatttaaccatttttgatcagggatagtaaagccacaagaaaaacaatgtgcgcctcgatggtcttcatcggcatctaagccatataccatcaaattgttttgtgatcgatcacgccctcctttcatacaacgaggacacccagtatgtccttcttgacttagatcaatgttatacccatatttatttacaacataagacacatgattctcctactaaaatgattcgtttgtctccataatatattgcatttccaaatcttccatatgtttcttaaattggtaaacaatttccgatggggaaatatctatatcaaaaagttcttttgtaccagaataaaacctaataccatcaacaataagaccaccataataatcccaatcactttctcgtgagaaagggttaggttcttcataatagtaatctacttcaacaataataggttctttattatcttgtttatactcaaaatcaaaagtgttcattataaatcctcgataagcagtctgcgggtttcatttaaatcatcaatattgtagttatctcttacatacttagcaagagccaatcctttctcaatacaaacatcaggagattcgattaagtattctacaatatctttccactctttaactgaatcagcaaagaagattagatctttaaattcttcagtataatagttctctcgtggcgaacaaacgagtggcaaacctttagcaccagcttcaagaatttttaaattacttttggcattattaaaatgattatttactaatggagctatggagatttgatgaccatcatatgcttccatataacactcataaggacgaataccttcataaacacaatctggttgaatatcttctttaatttgcaaccattgagcactacttaactcttcgtgatctctacgaaatccacataaagttaaatctttaccaaaatcaggaagaattgctaaatcatgtttatgtgtttcacttcccgcccaaaccagtggacttttagaataacggtctttcgtaagaacaaactgtccttcatcaaaaggtagtccgttaggcacaatatgtacattatcattgtattggcttaattcaacctttaatgctggagttgttgtagttacaagatcgcttctttcaaggaaccattttagatcatctcggatttgattttcaaataatccttcaagcatatgtccttcaggaataattaaagaatcatccagatccattaccaatttaaacccaagttgtttaagagccaggaaacctggctttccacgtgttggtactccattgaacacaaaaatattatgcttaggattaatggtcagtttgcgtttatatggcaaaatgattctatgaaaatcacatacactatacttttcatttccgcgtgtgtcaagaataatattaggcatatagctccttattaaagactttcaataacttgacgacgcagttcattggcatctgcaagattataattaagacgaacgtgttctgcaagcatcataccacgatcttctgtgtatctagggttcctcattagcttgacaacttcataatgccaagatgctttagagtctgcataaataacagcctttgcatctaccggattgaagtacggcagcacaggagaacagataataggaagaccctttgcacctgcttccaaaatcttcaaattgcttttacagttgttgaagtcattatctaccagaggagcaattgcaatactgtgaccataagagacaggacatatactcacctaaatttttaatagctggtttatactgtgcatttggaattttacgttttactttaacccactccgcagtagttagatactgactattatttccaacaggtgcagaaggatacacttcataccctgcaattgtcaatagcgtatcatcaaatgattagcttgtagaagagaaagggttcatggcttgctcctcccgcccaaataataggcgtgtcagaataaacgttttttgtcaaagtaaattgaccttcgtcgtaaggtagtgcgtttctaataacgacaacattacgatttaaatgacgaattttgtaagctaggtattctgttgttacagtaaccacatctgctaacttaatcatctctacaatagtctttgaatgattagtaaatacgccagccatataatgttcaggattaagcgaataaaaatcatctaaatcaacaataatcttaacaccttgtgccttcaggcgtttaacttcgtctgatccacgagaatacactctattaaaaactaaaacgtctttcttaggtttaaacgtatttccagcaaatggcattacaatacgatggtaatcacaaccactgcctaacttattatcacacttaagtacaggagtattaggatttaccatatttttgagcctcctcataagagataaaagttttaccattgcgaagatcctccagtgattgtttatattgttcccagtttacaccaatcccctgttctttctcttcttttgacagattcgcaaaaggtaaaggattgtctccaaacacatcgtcaggatggataaacgccataattcgaataggacatggtacgccgtgaatacctcggttcaaacctgccagtggaacgcgctgaatccactctgcatcttcatatccataaccgtgggtgtatgagcggaaatagccagctttctcaataactgcacgggaatacataccaaactggcacatgcctagctcccaaataaccacttctccttcaataccttttactttatctttaaagtattcaggcataccaaagaaatcccaaccattttccttcgcctgttttacaaaatatgtttcccaacctggaacaacaggataacaatcatcatcaaaaataaaccagtagtcatacccttcatcataaaactttttcatcagttcattacgggcatatgcaacaccttttcgttcacgatcatactgtacaacaaaagtagcattaggatcagttacaagataatctttaagaggacgcttacctacagtaataacaccaacaccaatttttgtattttccaaaataactccttaaataattttattcatgtcttgacaatgtaaaaggtgtgaaacagcttttctaggatcatcattacctaaacggtatgtgtgaaataaatataacccacgtagtaaacctagccttttattgttagcgtgcaatgctttagagaaaattatatcaaactgtattgatctttcctcaaaaggaatttcattccacagactcttacgaaagagaagaaagaatcctgctaagatagcatctgtaggtacttcctctattgagtttccccattctagatgtgctctttttgcaatctcaatgtggtgtaatatattcggatcttcacttctttcattattaaataattgatatgttgatcccaatctgttacaagatgcaccaagaacatcaaaatcaggatttgaacggacaattgattccagccaagcaggttgttctggaagaagaaacattgtatcaatgtctcttaggcaaatccaactatcttctggtaagacacttattgtgtcattgataccttttccaatatctccagaaagatagggagttatgtgaaatatcatactccctccgtattattactttagcatttttagaataaaaagtccaaatggttttacctattgattacgttttgcgagttccatttggatagctaaactgtgatctcgtgcttccatatactctttatatgtttcattaagatgatcacgacaaacatcacgcagtttaatcagtttatctgtagggataccactaagatcatcccaagattttacaacttcaccagtatcattgatcccaatggttttcatctacaacctccttaattgctacagcacagtttttgcagatacactgccctttacctttagaaatctggatgtaaggttcattttcattttcgcccttacgtgagtcatatattacagaattgaagcacacaacgcaaatattttttaagattgtatacttatcaactttcttttttgttttaaagttaacttcaataacatcagccatcagtgtaacactcccagtatgttgctttgtgacataaccatagaacattcaacattatcgtgactacgtgaaaaacgttcccaaacatcttcatcgactcgtaaagctatacaaggatagacgttatcattgatcatttcaattgaataaacatccatattgtcttcgtcttcgatgaacatcattgcaaactgttctaaatgtttcctaatgtaatgtacatcctcttctgtaagaccaataacaagataacttgcaacgataacgccatctttcatctatatctccttagcgatagaattgatgttctttgtagcggtacactagaaccatatctttttcccagtgtgctcttattgtagattttttaaagtataatgctccttttgtaatatctaatgcaattcgtaattctggaaaatgcgtatcgagataaagtagacgttctgctatagccttagcttccttccacttatcacgttccataacgttgaatgtctttgtgtaagagaattgtcctttttgaaacaaaacttcttttatagtatcagggaaatatgaatctctagccctatttaatactacattaccaacagcagacataccgcgctttccttgattacgactttctgcatagattgcacaagctaatagattttctttactatcacgctttgtacacttgtgaactactttagcagtttttacgtttgcagcttcggcttgcgccacaacaggtgtaaatgtaaaagcagttaaggatagtaacgcaattgcgacaaaggtttttattgacaaacttgcctcctattttgttaaacgaacttttattgtaacacagaagaggctgttttgcaagtggagggggattatccccctcttacactctgttagatattgtaaaccttcgtatgagttactacaccatcttctacaaaatcaatacgttcttgatccgtaactagtgcagacaatactttaaatttaattgttacacgttcaaaagctggttgaccatctttaagataattatgttcagttgttactgtcttgtttacaaaatcaacttttgctttaccgttttcgcgcaagtggaatgtttttcctgctttatacacaatttcaacattaccttcgagagtaattccttcaaaaagctcaccctcttcttcattttcttcacttttgaacagacgacgaaactcttccatatcaagataaacaacatcttcagaataactatcagtaaggtatgtcttaccatccattaacccgaaatattgccagatcgcagaataaacatcactagttgatccaagggtttctctgagtttagttccacggattacttcataaacttcaaaattgaaaccagactgcaaagcattaaacagtacatcactaacttctaaagcataatcttcattgttgtcaatatccacaagaaaattaccgctacgaataagtttttgaccttctaaagtaatacccattgttttctcctcttctatttaaaatatgcgccccgaagggcgctatgatttattactcgaaccaatcgtcgccagcgccaaacgctttaactacatcgtaaatgtcaagcccagctttacccacaccatacgctttcagtttccattcgctatcttctcgcaccagggaggcaacgtggcaaatggtgttacctgcaagttctggagccaagaagtcaaagtccagcagttcaacattacgttcatcatcgaagattttaaggaaaccttcggtagcgtgaccaaggcgtttcttacccgtttcgtcatcaatagtaattacgaatgcaatttcctgtgcttcagcagagatattatccagtgtaacatcaatctgctccatttgtcctacaccatcacgaacatcttcacctgcaaaagtagaacgttcaggatcaaatttctgcgcgtagcacaccaggtggcgaggagacaacagttccggcagaccagatgcattgtgtcggcaaatcagagcactaacatccagatccagtttttcgttagatttccaagagaattccagacgaatgcgtttcagtgctggtgcaatctttttcagagaaactttttcgctagaaccttttttcagggaaattttctgagtcataatttattatctcctttgttgttaatttacgttgtctattttactaatcttttctacaaagtcaagcgttttttacgcttttgctccgaattttttaacccactcaccaaactcttcggatagcagtttatcgtaaagttcttcgtcagacaaggacaaatctgcaataccgataaaatcaacattatcgtattcttttgccaagtctttcaggaatttaaagtttgcattacctacaccaaccataaaccagtaaacaggcgtattgcggtgtttgttcagtaagctacgtactgctgaagtatccatgttctccccgtcagtttggaagaaaatcattgcaggagtacgatcaacttgtgcatcagtatctacaacctgttctacaacagtacgtgttacttctacaagttcttttttaccagttagtttagcaaggaaacctttagccggaacttcttcatactcaacgacttcgcgtgtaatatttttcataggtacattaccgaagtatgtatcatagatctcttgcattactggagcataggctgtaccaccgttgatgcaaacattagacatgcaagagccgacataatcatcatacacatcagccgttgcaggaggcagttcaaaagaagaactattgaaagcccacatgtcaatctgtgcattatcatcaaatttcataccaaacggcagcagcttacctacaaaatcactaacagtgccatcacgatatagctcacacatactacccgaaatatctaaggcgctaccgacacgaagaacaacatcgttaatctttttcttacgcagagatacagtaagagtttcttgacgttttttaagactgattttattggacatattatttctcctttctgactgtaatgttagtaacttctaaatccacttctaccacttctgtatcatataaaatacagttaagttgacctctttgtgaaccgttcagacacattgcttggtttgtattaaccttaataaacactaagtttctgaacgtatctaaaccagcatcttgataggcaacataatatacgaatgtatcacctgcgtcaagttctccaaaacatttaggttcatctgattcgtcgtctttgatattaaatttaagcactatcttctcctttacctactttcaagcctaaatagaaagcctctctagtgattttttgcaactcgtttaaagagatagttacaactaaatcatcttcaatttctagctttgagtcttcttctgtctcaatgcaagtattatgcactttgtggtaaggattgtcaacacgtttaaatttattattttcagtgctgaagaagcaatctggatcttcttctccatcaccccaaccctggttagggtcttcttcagatctttctgttgggatctcacctgtaaagtgttcttctaataccagagcaatcccatctccaagatcggaagagaacatcaaattacaaacttcttcccaaggcatagaccacttaaatcttttacgattgccatgtttatcttcttcgttagagaaaacactaccatagctatcataattcccatacatctcttcgacaaccttaccacctttcaaaagaaataggtagcaaggagagccatcgaaagaggtagaaagagcagcattaccagactctttgcacaagaaactaaaacaccccattatacaccagccttaagatcaattaaagccaaagttgtttcagagtgtgtttgctcgtctacaggtgcagtcatatgataatacaaaaaatcttcggcatcataccaatctgattcttgaccttgtttccaaccatcaatgaaagcatcttccataatggtttgcaattcttcacgagttaagtgaatatctttactcattacacattctcctcttttaccaattccatcgttgaactatcaaaaccatctttagaagaataggtatagacagaacgtagttctcgcaggacagtgaatacattaggatcatctaaccaagcatcctggaggagaacataacgatcttcattgtcatactgaacagcaatcatagaaccagacagtttgtaaattttaatattcataatatatttctccttaaagtagaccacgtttaacagtttgaatcataccatcttcaagagattgcacttcttgaatgtaatcaatacgcgcagcacgggcttcagtgttgattcggttagtttcttccaacattttaactaagttttcttgatcgcgacgtaatgtttcaatatccaatacttgacgattagcaagttgtgtagcttcaatttggttttgtgcagccagatcactacccattgcaatagcagcattaaattcattcagcacattgttctgtgtatcggctgctttcttctggcgtagactttcaatatacatagaaaagtttgcagagtaagcagggataacattattcacaatattacgggctgatcgcatcaaacttgcagatactttctgcatactttgtacacgtggccccatctgaacacacagtaaacgcaaggctttcaggtctgcaatacgaatttcaagcagatccatagtatcacgagtacgttgacgctcttctacttcattttcaggtagtgtattaaggcgaacttcttctttttcataagtagctgttagaagctctatatccctgtttaagctaagagcatattttgcaatagcctcttctaaacgttgcagatatcgtaaagaatcttcttcttttttcaagtctgtttgtagtgtctttaccaaaccttcaatacgattattgatggtgtcaaattcaccaaacaaatcttctttcatacctaatactttcttaactagtttacctaagcctttagattgtttaatagagttaggatcaagttgctttgcttgcttaataagtgcagttaaacgttcactcatttcatccccctgagatgaacgctggtgtttaagcacttcagcattaaggttacgaagagtaagtcctgcatcagcaccaacttgttcaatctcttcacgagacattggaggcagcatttgtacaggtcgtgcaacagcaggggcatatacagggcttgcatccatagcacttggagcaaacaaagacttacttttttctgttgttgccgtgaatacactcatttcagacggtttgctttttacggcactgataaaaggactggacattcaatttcctccatattctttagtagatggtgatacctctgtaccaccatcataacacaaattaagtattaaacaaacatatctaaataatttgtagtaataaatgctccatctgcttccagattaacataaccagtagcattagtggttaagaaatccagatcgaaggactctttaacaccccgtacctcaacacgagagatatcgaatacaggtagtgtaacagcctcttcgtgcaataccgtacctttgtaggttgccttaatgataaacttgatattacccgttccagcatcatacaaaacactttcaaaccctttgagagtatacttatcaccagaagtgaagtgcaaagttgctttgtttacagtacgtttcttacgaggagttcctttcacacgtttatgatcactacgttttttgtacttaggaatgaatacaaacgatacattctgaagaaaggtatcaacatcaaggattttaatatcctctgttgcagcaaattttgaagtcgttgcatcaaaatgcttttccctgcgatcatacataaagatatcaaaccgatcttctaaatcaaacaaattatgtattttaatttcagaatgcttgcgcattgcagcaaccttgaactcttcaaaacgtgggtgttctacaagttcttcaagttttacaccaaagacagtatattgcttcggagttttttctggtgttggcattacagaagcataatccccgattgcgctcttaaagcaaaattgttcttgacctgtatttttaccaacgaatttacagtattcatcattgtgcatactttccttagtagtaccaacaaactcaaaaccatctttattcttctcaagaatttcttgattaaagatccaaccttccaggcgatacactttaccaacttctagtttcatctgtttctccttcttatttaatctgtattaaattattaacgacgacgtgagctactaaaactacgtttcgacgaagaataacttttcgaagacttactataagagctaataggacttgagtaagacttacgagcagagtaatcactattcacttttgttgttgatgggcgtgaatacgtttgtacactttgctgcttaattgtgttttgtttagtggttgtatatgtatttccttgtttatcataaaaactatgcttttgtgttgtatatgctttgctattagttgtaggagcagcgttgttattgataattgttgtattgctaccgccatctctataaccaccaccgccactattaccactcaacatatgaccaagaagcatacctgtagcaaactcacctacaccagaagaaccactgccgcctccttgcacaacaactgttgaaggttgtgcaggtgctgcttgaacaacttgaggtgcaggttgatttacatattgttcatctaccatctgatttggtgtttgttggtaacgttgattttgtacattttcagaatcatcacaacctaccagcaatacactacctaaaacaactgcaacaataaaagatttaatgtttttcatttgtaaccctctcatttaaagtctcaacacaatttttaaaatccctagagaaacaatacatctgttctccgttcctgttgatagtaattgtatggttatcaatatatgttgtcaagataaaaatcaaacaaaacaaccctagagcaaaacaaatattttcaaacagaatccaaagaacacgtaaaaccaccatcagatcacctcaataaagcccccgaaggggcttaatgaattaagcaacagcctggtcttctttttcagggaagattaaacttgcaataacacccaacccaagagtacctaacacaatatacatactgatcgtcggatcaatgtgtgctggtaggaaactcacttttgcgtgcagagtttctgcaaacgggtgatacatcagttttacacccacaaataccaggactacgataactgctttctccagatgaaccaaatacttcagtgcaacactaagaacaaagaacagagcgcgtaaacctaagattgcacagagcatcgaagagaacaccagcagaggttcttgtgtcactgcaattactgctggaacagagtctactgcaaagattacgtcaaccatttccattacaaacacacaaaccagagccggagttgctacacgaacaccatttttgattgtgaagaacttctcaccatccatctgatcagatacagggaacagcttacgaacaatgcgagtagcccagtgtttagagtaatcaacttctgcatcattatctccagcgaataccattttagccgcacagaaaaggatgacagcaccgaagaagatattaacataccaacccaaactcaacaagtaagtacctactgctacaaacacacctcggaagacaatcgcacctgcaataccccaaagtagaatcttgtgttgcaagtgtgtgcttttaataccaaaacttgcgaatactgccacaaatactactaagttatctacagaaagagatttctccaacacatacccactcaagaacaaactcgcaaaatcagcaccgtgttggaagtatacaaaaccatagtaggctaatgataccccaatccagaaaattgaccaaccaactgccgatttaaatgaaatctctttgttttctctgtgtccaaagaaatcaatacaaatcgacaacactaaaatacccactaaaacaaccacatcaataattgggaaacccagttgcattcttttctcctctttaatgcggaggacaatcctccgctctatgtcttatactataaactgtttttaaagaaagtcaactagttcagttctgtaattttaagtttatcttctttgttaatgatagggaaagctacagcatcacctacgtcatcaataaagcaaatagcaaggccaccttccactttgctaatctgaccattaaaggcgtgatacggggcaggaacttgatctccatcttcaaggagaatagcctcgtaaaccttgccgatagtacaatcacgagtgtttctaaatttttcaagcacttcaacatttactttacgcatataaaaatcctctcttatttgttagattgaaagataccacggagtaccgcaagaatgaacgtcacacagactacactccaaaacgttacaggaacatgatgccagtctaagccgataatgtcaatcatataattgtatgctaaaagcagtagccaactagggattaacacaatcaagaacacaacaataaaacaacctaatactgctaaaacacctgccatactttctccttatttcagtttgtaaacaattacatttaaacctttgtttactagagtttcttcgatcataagttttacaatattccaagaacctccagccaaaccacaaccaagcattggtaaacctacaattttaccgcctgaagatacaacatcgtctcccatactatctagcgcattgtagatagcttcataattcaggtcacgcttaccttcctcacgacgactataaccatattgtccatataaattataaattgtcaaattgttttctgtatatttggtaaacgtacctaattttttataatcaccacgtttagtggcacaatctgctttaaacgcaccaggccacttgcttttaatttttggtgcaataccactacccatagtgcaaaaacagttacagcagtgtgctatagcgtctatatcgcctctctcggctgctgctaaaagatcaccgtatacctcaatgatacctgctggataacttgttacaatttcatcttcccagtacattttctctacaccaccgatcagtgcaaagttttgtgtaatgcgatcatcaatatagttaagacctgaaacatacacagcgtattcatcctgtgctgtaataccttgcacacgaattcttaagacaccatctttatctgttgctacacgcccaaaatctttttctgtaatattggtgataggatctccgaaagtcattactttattagacataataatcccctttaacattagatttgttgataatgttgctttcaaaaaattgacgtaggaaatcaaagttctctttgtatttttcaatgttattgtaaccttctgcaaggcaaccaaagaacagttgttctacataatacaaaggaagttgtgaaagtgcaattttaaaatcaacttcgctttgactcattagatacttaatagggacgaaccaaacatttagcatcagtttcttgcttaatcattttaataaaagctgccagattattgatatagttgaagttaagtgcagcttcggtattggcttctgtaccttcatactttgcaaagtacaggaaaaacgtatcgttttcaacaccttctttgtctaaaatttcaataagtttttcttcgtgtgttcctgtaatattaacatcatcaatgaaaatcagagttttattaccccagaaatcacgattgatagagaaagtgtcaccatcgatcaaagccttacgatcttctttgctaagaaatccataatcattgatatagctcactttacgatgaacgatatcccactccactgctttacctcctttgatagagattaggtagttgaggtgatctacaaaatgttcagataacactgtagctgcatttttcacatagttatatggagatggaataacaacaaaactttcatttaccagtcgttcttcatacttggaaaagaaactttcagccagaatgcgccccattctttttgctgcctggttactaccaaactttagtttggaataatctgcaatgttaaattttgcttccttcaggttagtaaaagtattagcaaaatgttgaatttgattacgcattaacaagttcctcttttttaagtttagccaacaagtcttctggattaataatatgacagaacttcatccctatgtcaacagcttttccatcatagatcaaactatctccaacgtgtaaaatctcctctggtgcgagatcaaacgttaccatttcatcaaaagagagtttaaaaaacctaggatctggtttacacaagcaaaactcgtcagaaaaatgcataaagtcgaatggtaattttgttaaaccagaatatacagctaagaaactacctggtacaaaattagtattactcttaatactcaaagagtaggttgaacttaactcttcccaacttcttgcaaagttcaggattcaatgttggaggatgttttataaacattgctaaacagtctctttttaacccatccactttatcaagatcaatgttcaaaggagaagaaagtgttccccaagcttttctagatgttccacaaatgcctttttctgcttttaaatccaagagagtttttacctctttatatacggtagctgcttctgcctcagaacaagaggcatactcggcaatgaccttgttgcgctcttctgcatacaaagggttagcagtaataagagtattccatacatcaaaagaaatatgcttaacagtcatttttaatcctccgtccaaaagaatatcatctgcttaattttattgatctcttgatgtagtaactttccagcatgtgattgatctttaatattgacagcaagaatttcaagttccgttagtttttcttggatagctttatattcatcatctgtaagcattttcttcccctttagaatggtaatctttgtatgtcacttatccccacaccaagaagtctagcaatatccttatctaaaagcaactctttttgttctaaaatgttaattagatctcctaatacttctttaatgtcacgatcatttttagcaacgtgaccacctgctgtatcaactttatctttaaaaacaaagtaatgatccataataccctccatataaataaaggaggctttcgcctccttttatcacttagtaagaacgaccaccaaacacatactctgtgtagtttttacgctctttgtttttaataacaacttcaatgttgttgcctttatcatcggtgaacacaaagtgataaccgtcaccacccattgtacggatgtgtttttcatcatacgtcagcaagatacggtctacaccccagtagtagtcaccttcttcatctttgtcttctactgtaacgatcccttccatttcaggaagatgctcttctcctagcttatgtataagatacagacataacgattaccgctaaacaaaccctgtgctgtcataccgtcaatatcggtatctgccgaaacatctcctgtacgatctacaccgttgactttcagaagtttaacttcttttgcagcatagcggtgttcagtaatactgatacccattaatgcaagtgcatcagagaatttgtcattagggtaacggttaagttcttctactaaggactgaacaatatcaaagttcaaatccacggaaagattataaagcgtttcaaaatctggtaaaaaggctttgttctccagatttttagccagatagtcatccatagtagctttaggtagtttcttatagctaaagctgtagaaaatacggctaggacgattacgcaaaaattctgatacataaccatcatttttagtcaatacaaacagcttgtcatagccaccaacaccatccagcagggtaagcaaaccatcctgtgcatctttttcagcatacagtttatcaaattcatcgatcataatcatcacaggttgtgtgattttagacataaaattgataaagccttcaccattaaaagcactaccgatagaaatagtaggaatacccatttcacgaagagcagaagacagcattttagcttgcaaagttttaccgctacccttcgtaccctcaaggagaacacctgtgtttttacctttgcggctaaggaacgtcttgataatacgttctgatttatcatcagtatcaccgtatgttactgaagggacttccatatcgtttttaggatacaggaagaactcaccactttgagtaacacctacaccaaaagttcctgctggaatttcttcgacatctgtaccagacttctgacgcaggaagatttgattgccgaatactgtaaacatagttttctcctctatttaatttagtcagattcccaaatgttgtctttcttaacccacattcgttgattatctgaacctctataacgtttcgttgttggttgattcatatcatacttaccatctatcactatgtcaaccagttttttaattttttctggaatttcttcaaaaagatatcctgtatataagacaatatcttttttgtttccaaaacaatctcttaccttctcaagaacatactctacagtgtcaatgttctctttgtcaagaggttcaccacctaaaactgttaatcctttaatgaaaggtcgagataaatctttcaagataagatctaatgtttcagtagtgaactcttgtccgtagttatacgaccaggctttctggttaaagcagccacggcaaccgtggctacaaccgctcacccacaaagagcatcttacaccgtcaccgttgagcatgtcaacaggttcatatccggcgtaattcaaaaatgtttctccctttctagtacctcttgcattttacctttattataagggcgagagttaggagcagaaaggtatcctgacactcttctgatcacagatatggattcttcttcatgattaccgcaacttggacactcgaagcctttagccgttgctttaaattcaccatgaaaaccacatttgaaacactgatctacaggttggttcacaccaaaataaggaattttattgtaggcataatctacaagagtttccagtgcttgcaagttatttttaaggtttggtgtttctacataacctatgttcccaccattactgatttgtgcaaaaccttcctcataatcccacttttggaacggggtagtgtgcatccatacaggttgatggaaagagtttgtcaagtagtcacgatcaatagaaccaggatagcgatcatttaatgctttggcaaatttatagcacaaggattctgctggtgttccatacaaactaaaagctaaaccagaacgttctttaaatgtgccacagatatccttcatatattgaaggatgtttttacccattgcttttggattggtgttatttgggtataaaatctccatagcttctgctaaacctacataaccgatactaatagaggcataaccaccttcaaatagtttaccaatctcttcattagcttctagtcgagctaaagccccttccataaacaatgtagggttttgagatgctttggtatgtctaatacggttaacacgtagcatatgtgccttatacgccatctccatatgttgttccaacagttcagtaaataagatgcccttttcacgggactctgctgcaatgataggtaagtttaaagaaactacgcctaagttgaaacgaccatcatatttttcaccttgctctgttgcatagtatgacaagaaacttctacacattatgttcaaagtggctcgcaaggccactcccgcaccattacgtgctgctgcatgtcaccatgcagatcagactatatcttcatgcttaaagcatgtctaccatttggggtgtcataggcttacaccctacgctgctacattcatcacagctagtcgttaggcatttcgtaacagaactcataatcataattatttggtgctccgcgctttaagattgcagatattctttttctgtccaaccctaaagcgtcagcacaacatctcagacttttaaagtaaaaaacttcaccagtagccttatgagtagcttttacactgtgacaccttgtgtagaaagcataacagttattatcgtaaccctcttgcgtgttgtctggacaagatccccactcaagattgtatacactgttgtctttcctattgtcacctttatgcttcacataaggtaaattgtctggattgggtaaaaacgcttcagctacaagtctgtgcacccgaaagcaaacagttttcttgtttttacgtattctgacaagttggtatcctgtgtttatttcttcccacgagcgaaggattctttcatccttatacctggtacaataaacatttccaagctcgtcaatttcatacccttcaaaatcacgaatttgttttctcatatcagtacccccttcttctgtgttgggagttctgttacgtttagcacgggattgtctcgttgagagttcccccgtttaggcagattttacatgagcagttatagtttacccatgcttgtgacgcgaccatctgaagatcctgtaacttctttgtttaaaggtacagagataaaatcaggataaatgcgttcagcacaacactccattgccagttgcttcaaatcatagtttggatcgccagctttcatgttaacaccatcttccaagaagaagataactttaggaaacacaggagttaccctatcttttcctaatccttgtttgtgcaccattaggtagtttttagtgatcattctaccaaaagcagaggtatccaaacctaaactaattgttataaaaggtgactgaccatttacactcattagggtgttcacctggtagattaaagtttgcattgcatcatagacctgtttatctaccatacgcatagcaatatcataatcaccaacatcagcatatattttattaaaacttgctttaacgtattgactaagcccagtatcaacatgtgcacaagtttgtccaccatattggctagaagctactgcttgaataatttgagttaggacagtagtcgccacaccgatagattttggtttttcaatatgtgcattaccaatacggaaaccgttctcaagcatatcttggtaatttactaggcaacaattagttaaaggtgagagtaaataatctaaatcgtggatgtgaccatacccacttttatgccattctgctaaatcttcaggtaaaatatgggtcattgccatgtgcttgcttaggatacctgctagtaaatctcggtgagtattaacaatcattgcaggtttgtttgcattttcacgagtaaattcttcggatgtttgttcgaggaatccgattacatcctcatatagtttttgggtcattaatcctccgtggaaaataaaagccagcttaatgctggctttagggtggatctttattttaaatctttttcgtaagattgtccttgatcttagtcaaggttttggtaatacgtgtacaaccgtcagaagtcaaaccgtcaacttgagtttcccaagtaccatgaatatttcggaacaatgttgttacaccttttggttcattaataatgattgccataacaagtttaggatcgataacagacataatcttttcctcaataccctctgtaataacattattgcgcacaatattaattgcatcttcttgtacagtaagagcacttacgttcttaagagtatatacctgctgcgtagtgtaaatgatacgaacatagcttacagaacgagtaggcacaggtttacgcggtcggcgaaaacgtggttttggtgaagattcagtcttactttcattttttgaataatactcctcaaacagtttagtaaatgtttttacatcaactacaaatcgatctttcctatatggagaattcttatgtgcaccattaataccactgttttcatcgaagaaagtaatgttttcttcagttgaatacattagataatgatctgcatttttccaatgtggttgtggacaatgaggattacaaacggaaagcaagtaattaatattttcttccgtggcctcagtatccaggaaacacgtattatgcacagtcagttgtactttttcagccatatctttttctttatcctctttagcaagatattcagtacgaataatctccagaaaaccttcaggtgttacttccataaatttatattcaggatgaagctccatatattcaaatccacaaccatctaattgctgtagaaagttagggtagaagaacaagtcattaacactatgaatcagatcattgatttctgcttcagatgtgtaaccaaaacttttgtgaattgcttcgttaagaatatgcaggatacccatctcttctgctgcttttttaacttccagtttattagcgtaaaatgcaatcattatgttctccttctaaattagtttaaaatttcttttgcaatggtagaagcaagttttccatcatattgattcggatactctgctttaaggtgtttcatcatatctggcattttcttgcctgtcaaggcaaattcttcagcaatagctcgaagatcatcttcagatagcatttctggcaaatatttttccagagtggtgatatcacgcatagctcgctcacatttgctaatggaggcattaactttcttaagcgagtctagttcctctttagcgtgtgcaataccaatcttaacaatgttaatcataatatcgtcttctgatttattcagatttaccttttgagtacgagcaaggtcaaactcaccaataatattagttaacaaagcaaaagcacccttatcggttgtacgtgctaagatacgatctgctttcatttgtgtcacaatagacattctattctcctcttattcgctaatgctttgaatcttatttacaacacggtttattgccagtgaagccctaggctccgcaataccagttgcagagatataaggatgaccttttggagactccctcataccgaatgaacctaattctaaaccatattcatcctctacgtcaacccccatattagtgggtactaaatatgttttaactccataataagtagagaagaaacagcgcatagcgttagcatactcttcaattgtagcatcagggtagaactcaatcaactccaatttcaagaaaatattaaaatgagtatcatctaaattttcttctgtgcggtaacatggtgttagtgccatatacggattacctactgcaaattcaaaaccatccttctccatttgcaggaaagattgttctgcactagctacatagtatttaccgttaggatgccctaatgggcgatcctctttattttctggtagtgtatacgccagtatatcagcatccacgagatatggaacttctaacatttgtgcaaatcgaccatagtaatcaatagcttgagctattactgcaacattcatgatcgacctccattgcggaatgcacgtttagtaatgtttgacatagtgatcaaatcttgaagcgtcataccaggaaaatgctgttcaagaacaccttcaacagcgcctacaatatctgacaactcaataagttgcatcagcttgcaatcttgatcaatagcatcttgaagttcataaagctcttcttgaatcttagcaacagaaccatactcctctttgctaatctccttcaaatgataccctgccactttaacccccttagtttaccagtttatttatgtctggtaaaagatttatttcacctaagaaatcaccttcaccttcctctagccaactctcatatgcttgtgcatgattatagttaccatcaaaagaatctgcaacaaatttttctacagtttttcgagatgtgccagcgccaaatacaccaagtttaataccattgatcggtaaagtggtgcttgttggtactttctctgttgcaacacggttgatatctataatctcctgtacggttgtgttccattgtaagcatttaacacaacgggtatgcgctacatacagtaggtttcgctctgcctcttccagtcctacccattcaccagtctttttatcatagttggaaggaaaatcattagcaacaataacctgatcccactccaaacctttagacttgtgtgctgtagtcagtgtgacttttgctgtaggagaatttctatgcgttctaagtgtatgtgctatggtgttcgccttaccagaaactacgatgtttaacaagcgtttagcatctggatcagcctctgcacactcaacaaattcatcccagtctgcgtaaggtaatacagtttcatgttttactttctcaatatctcctctacgaagagcattaacactatctaccatagagataaaatccctggtatctacgttaataataatttcttccccatctgcaatacgatccattgcctccataagcaaggttaaattcttgcgaaagatgatagtgtaaggttttgtatagtctacaacatctgatttgtagctacctactacagtatcaaagcctttaccaaccaaaggatgacgcaaaggttctttatcgcttaaaatcatattggcaatgtttgccactttggggccaaaacggaagcaagcagttaatggaagctctgccccatacttagctgtttcaatcatcatattagagctacctctaaattgataaatgcagttgtggctaagaatttcattaccaaagaagttagcagtatcctctacttcaatatcataatagataccttcactatctacaatgtccacaatttcttctgccgttacagtatcaccatcttttaccaacacagacatgcctttaaacaaacccgccgccggaattaaagtatatttggcggtgttcacagaggacatgcattcttttaaagatgcaaacggcactatttcaaggatcttttgtgcaaaactcaatgcttcacgataagaattgaaatatttacgtacacggtaacgaccttccaacttagcaacacttacgcttacacctgcttcaatgagtgaagcatagattgacatttcactttctgtccactcaaaactaacttgtgttcctttacaaccttgtgctcgcaaagtcactgttaacatttttctttcatctactgcacaattgatgctgtgccaatgtggataagcaaaatgataatctttatcctctaaaagtttaaaaccgttttgtccgaattgttcaaaaatgttattgatcctttcttgattaatgccgcgtgaacttgcttcaaatacacaagtaggaatgccatattgtaaactgtatgccatttctttttccatagcagcttcacggttttcaacaatatccaacacccacaatttctgtgctttttcagaacgtgtacgttgccccagtttagaaaaaccttctttatcatcgaatttgttagtaattcctactcggaaacctaaatctttcctccacattagatataccaccatttgatcatctttcagaacataaggtgaagcccaaatacgatgattatgtgtcatatctaaagttttacctttagtagtaataatattcctaccttttgtacgtgtagataaagtcttatttgttacttctctaaatgtaactttaccgttagaataagattctaccttatcaccgatttgcaggtctttcattgtaacctgaccattctcggtattaagtaccgtgttttctgacacgcattggaattcatcgccaactaccacaatttgttttgcagatttagcatttcgcagaatagacaagaatgcagggttaacatcctggaattcatcaccaaaaataatatcataaccaagatcagcaccagacaattcaaacaattttacataggtgtcatgcgtcatcaaagtatctgtgttaggatcgatgcgctctcgccacaattgttttgcatacttaactacttctgtaattagtttgtgttcgttaataccttttcttttaatatctgcaagatgtacaccaggaaaatgtttacggctaataaaaggatcatccgaaaattcaaacttacctacggtttgcttgatcattaaaccaatcatagcacgagttaaaagtgttttccctcgtttatcaataagattattaatcttaaatttctttgctatctcgctacctgtacctgcaacgttaacatactgtccttctggtcgtgacagttttgcacgtaaacgatgatccaggaattgatagcaaatagaatgcaatgtacggcattctacatttagtggcatcttacgtcgtgcttcttctgccatgcttttattgaaagctaagtaaagaatgcgatcttctgtactgttagccagcaaataaagtgttgacgttttgcctgatccagatttagcttggatagttaaaaaacgatggtctggaaaagcctccttaatagctgtttgctcttctgttggagtaaaactcaactctttcttagccatttcaacctctcttaatttgtttaacaagcataggaacaaaatctcgttttaaaatttgttcaataatatgatcaggtagctgttggaaattataattaaaagctactgtctcacctttaggtgtttctacccgcacatataacatgttacgaagtttatccacttgtgctgtgtattctaaaccatgtaattgatgtaatgcaaacatcaaatcatcagtttcagtttggaatctatcccttccctgcatcaaggacaaggaaaaaggtagattttccctaagagccaccttcttaggcactagtgaagggaaatactccccaataacttcctgtgtaagctgaatacactctttttcaagctggttttgttccttgagttcacaaacactcttttgtaaagtattaacctctttttgcaaagctgctagttgagcacttaactttcttttttgattacgaccaaaacgtttagacatatttccccctagtaaaaccccttaacaatttgtattaactcggcacaacggttgaccaacttttcctcacacagtacacgttgtggcatatgttgtataatatactccatttgctcatgccatgtccacttttcttttttgtccgggataacatcactagcacgagaattatcttttaatgtttgtataatccaattgcttggaaagtgctctccacctttcttaaatggtttatagtggcctagagtgaattgagaatcccctgttagagcacccaatttatttagatggataatcaaactacgaaacacatagtattcatagatgttatccaccgtatagcaagcataatatttcaagatgcccttatctcgcggatacttaccaacatccagattgcaccagttgacattttctggatcatagtggtgttccttaagccatatttctctttcatcaaagtctggatatattaccgctctgcttacagagtcaacaagtggagattgagcatcaaaaaacattatattttccttattggtttgttaaacgttttctaaatcttttaaggcattacccaacgttagaacaataacatcgtttgctgcctcttccccattgatattggtgaaatttggtgttacaaaagtaaccatataaaactcgtccacctggaagatagcaataacaccatccatcttaacatcttgacgaaaggaaaaaccaatcatcttctcttgcaaaggcatatccccttccttcattaccgctagggagttttcaggaatgttatatttatctgctccaatgtagatgtacgtaatgttatctttatcgtgatgatacagggttgctttttccatatctaaacctgacagatcaaatacgttaatttcttgtgtagtcttcataaatatcctcccaaatccaataatcatctgtgtaagtaggatgccttttatcccactctgttctagcccaagcaaccgctgctaccaacacatcaccatgacaagattgaggtgagcagaagcaaactaagtctttcccttctaattctaacaaatcctcaagagtgattttaccacaacgaatttgttcccacaaccactctttatatctttgtatagttgaccctcgtggttcatcatcctttaacttaaaaggatttgcaaactttgaggcttttaaccccatatgaggcatagctctgccaatgtaaactgcaccttcaggtattactttacctaagtggtagaaattcaatactctcatattaacccaaacacatttgtgcaatcaagccctgtataaatttattagcttctttactgtcgtagtcagtttcttctggatatccatcttcatcgtacacaactgtaccttcaatataccctgcctcaattaaggcgcggatcatatcaaattgccagcatgagttaccaaatggacgtttaccattaaaacactcttcttctctccataacgtagagagtagttgtcggaaatattcccgtacagtgacagtaccaagatctgaatcctcaaacataacatccagggcatcaggattgcttttctctacataagggatatatttaacaccattaatagttacatcaagcacttatttctccttatcatcatattctaggaacatatctgcacgatatgctttacgctcttcaaacttagcaggatctacaacaataagcaatacaaggttaacatctaaatacttcttaacaaatagaaataaatcttttccacagttaaaacctataccagtataggcatccccatattgatctactgatttgatcttcttactaaccgtacactctatgctattcttttcttcttggtataaggctttcccaccccaatatgtaaagaatttagtaccgtcagcaccaagtttaaaaccctctgttgcatgtcccgcaaatgaaagtaagcataaccaagtgatcatcaggtactttagcattttaaccacccaattgcaaatgtttagaaagaacaatatcccactgatcaccacaaccgttatctatgcggaacataatgtacgtatcatcttcttctacgacatataatacttcataggaattacaacagccttcccaatttttaacagcctctggtgtatcatgtgtaaaaatttcattaccatcatatgaccaaaacaaaggggtaaggttttcgaaggtcagtgaagtagggtttacttcatctttaactgcttcctcatattctttatgcgtttgtactgctttagttagtgtactcatgtctatctccttttctccttcttgactatggaggatagcaaactctctaaactccacttcacgccacgtttttaggtagtgctttataattttatcaacatctgcctgttcaacattacttttcaagcaatagtaatcatggtcttcgcccattctaccccatatgctatacattgtcatctgattgatcctttacattgttcttggcatacacaggaataacatcattatgatctttattactttcatctgttaaagcccaaaacaacttacctgctggatgtttaaagatgtaagcaataggttcctcttcctgggcttctttgctacggataccatcccgccaggcaagccaagtgtagatcatcacttcttgacgttcttcttcgttaggccacatatgtgatggaaagtttttatcaaaccattgcttaaattcttcagtcatagtctactccttagcgtacaaagttaacttctgcttctttcagctttgacacttctacataaccaccatgatcatctttaatccattcttttcctttacggatgataacaggatatgtagagtgagtaagtttaggtacagatctttttgttttagtgatagaaatgttttgcatattagtctccttagtaaattttacatagagtctagattatttagtagatagagtcaataactaattactgttagatctgtattctgtcttccattcacaatggtaaacttcaacaggttctaacttccaatgttcaggaactaattcagggcaatatctacaaaagagaaatagatagataactaagacaggtattaaatagtaaaatggtatacgatcataaccatacttacgagataacatgtagacatatagatagggtataacaattaatcctataactataagtaagaagagaagtataaaccttagtgtagtaacatccatagtattctcctatacagtaatatactctgttcctgcccctccatgagtgacaggaacaatatctatagagaatactaactcgcttcgctcgtcacctttcaggtttagggtagcatgtttttctgaaaaagtcaatactctccacaaaactttacaaaatactttacataggtacaacagagtctgttttgaagtcgtacatatgatttacacctgtgatttttgacatagagattgcacgtttagcacctgcaattacctggtctgtcttcttaatctcttcacggaacttacgtacagttaaagagaagaaacgatgatccatccattgacgattcacacgatcacgcttgaagtgacggaaatcttcaatctgtttattgcgcaatcggcgcagtacatgcaatagttgatagtaagggtgtttatttttcataatttattctccaaatcgaaaatcgtcaatatcatcaaaccatacacaatggcgagtcctttctttttctgttgcagacattgtttcaacagctttaggactaagcacaacaggaatgtaacgaacaggtcgttcataatagtagccatacttttctgtattagctgcctcaaagactttacggcgttcttcaagatcttctatggtgaatcctaccatataaccatcatgtttgctaccccatccttcctcactttcaacaatcgggatataaaagccgttacgcgtccctgacgctggtttttcttgagcctgaaggcaagcctcccatcctgctttaaagacgttatagagcgatttacgcacgttatgagtgccgctttcgcttgctggatagagttcattaaatttgtcttgaatttgttgtgtcatactcgccccttagtgattatttgaccaactaaacaaatagcttgtagtacaataaagaagtagcctaattttacactacccaatacccagaatgcaatgtttgcaaacaaacaaaaagcaatattaagtctaaagaataacatttaatccccttcatatttaggtaaaggcatatatgccacaataggagggtaatcaaagtgaaaatgatggttcaccacaataatcttaccagacatacttttatgcacttcacaataccctttttcaccatcttccattaccaccacatactcacctagtgggatatcgtatggatcttctacttttacccattctgtcattttggaaacacctcttgtccatcttcatgcatttgtagtaaagtttcacagatttcatacacatcttggtatgttacaactgagagatcagagtcttgatcttcgacaagcatagcacaaagagctttaatatcaatacctttacaatgttccgtagctatacggtacatttcaccatcctcccaaacaattggttgcggaagcaaaacgtctgtaccatcttcacaagttacaatgtaatctgcaatattatcacgaattttcattgtactacccccttaaatccagatgtgctgccagttttaacttttgctttaagatgttccaactctaccataggtgttgctacttgtataggattttcctcaacctcatgaatataatattcataataagcatacttaccaatagagtgcagatacttaattgcatgttcaggcgaatctgcttcgacataccctaaatcttttgtggtacgaccttcgcaatcaccttcggtagttacatgataaagtgtcataaaacctcctcatagtaaggtaaagccttgatcagttgttctgaagtgccattttgcacccacgtaaccccgttgtcaacagaaacatacccttttttgtcaataaatttacgcagacagccagtgaacttatttttgtagataaccatgtttactccttgttacatccacagattatgaaaatacttagcaaacaaaatgcgaccttctaaacgatcttgccgctgtttttcattaacttcttctggtggagttgaatccttaaaagaagactccattttttcaagaatttccaaccagtgttctgctgctcgttcttccatataaggtagatagtcacctttagcgtgtgggtacatccgacgaagtaacccgctaggaattttaacattgtttgtggctatcacttttgcacgatatgctgaaagtgcattgtagatcagtttacttagtgtcacatctagatcaagaagatcactctcttcaaattgaatttcatcgtgtacaattttcatatcactctcctttatagtaaaacacgttttgcactgcttggtgcattgtcgaacatgtctatcactttgtcaagtttgtgtattaactcgttcgtaatgttccactctttgtatgatctccattgtttcttattctcacctacctggtgtaaaactttgattggtgcattcaaacgtacattgcgttctttgtcctcttcaaaagaggctaaccatttttcgttatgcccatgaacagcaataataatgccaaaaccatcaaaagtttctgtaatattcttagttgctagtgtgatgttcatatctaacctcttttgttacgatgcacacagagtaccagaaattaatttcagatcaagtattgacatactgttttattgtgctaatcttaatgcatacacaaatgagaggagataaacgaatgcaaaacatcgatctgacttggatagaagccaaagaagcaatgttaaaaggcaaacgcgttaaacataaatacttctgcgaaggagaatggtttgaaatgcgtaaccgatccattgtagatgaaaaagggaatgacatgcaacaatggttcaaaaatgaaatttggcagggaacaggttggtctgtagttgaagagcagcctagctcaagcgcactgtttagccctattatgtatcgcgttatcggtgctttagttgttgatcacggaattgcagtggaaaaagaatgctgggaagaggtatcttttttcaacctggcttcttatgcaaaaagccatatgcacttgtttgaagaaggggatgaatttgttcttcgtatgcgatatggcaaagaattcagattaccacttgataatgatgtagacactgttgtaaaatggttagcagagcattacgcttacgatgcaatttgtggtcgcagcttcggcaacgaacgctgggacatgatttgtgaaaaatatgattttgagccggagtacggagttttataatgttaagtatcaaacctaaaatgataacagaagacgaagcagactttattttcaaatgtggacgtgtatggagagaattcacaaaagggaatgaagtggttgttgttgtcgaacacaagatatctatccatgatctgtttggacaatatgttgatgttattaaattaggtattgacaagggtttagttgaggtgttaacattagatcaagttgaagcagagcacctcgataaagtggtggttgaattttaaaatacagacgggagaaaggtatgagtttctttgttacagtatttatggctatctggattgtagtctcactcgttcttttcctggtgggttgtctggaagagattaagaaagcggttatttgcggtttctttggctttattatctctcctgcctggatgtggttcttcattatgattggtttccttaaaaggtaagtgaggaataaaggatgagtaaaacaaacgcaatcgcagataaagcaacggatgtacttctgaacatggttaacgtcactattcaaacaatgagtgatgttgtagagtttggaaaacaacaaattccagaagtaatccatcaattattagtgtggaaagcagtatccgcaggtttatggcaactttttagtatttgctttatgtttattacttttattgctgtgcggaacctcgtaaaagcaattaaagataaagaatgcctgtggtcacgagatcgctatggtgaaatatctgctttacctattgttggtcttgttgtctgtgctttctttttctttttaggatttgttattttcttttcgaattttgattggctaaaaatcattattgcaccaaaagtgtatctgattgaatttgctgctgatttaattcgttcatctcaacaaaaataaaaggggttaaaatgaaatacacgatttatggtgatgttgtaagtgtaaataaagatatgggcgtggaatctaactaccttccacctggattctatactgttagtcgtgatccccttggcaattattttttaagccgtggtaatctaacaggtgtaccggatgttctgtatggtgaaacagaaaaacgagcaaatcacgttattcgtacattccatcgccggagtgcacaaggtaaaaatacagggttgctcctgacaggaactaagggcagtggtaaaactatgttagccaaactcattagtcgtgaccttgtagaagaaggtattccaactattatggttactcaagcctacagtgatgctaatttcattgaacttattagcaagatcaccgacaaagcagtgattatttttgacgaatttgataaagtgtatgagaagaaacaagatcaagaagcacttctcactttgttagatggtactggcagtggtaataaactgtttattctgactaaaaacagtggttttatctctgaattctttttaaatcgtcctagtcgtgtgttttataattttaattatgataaaatctcactagaaactatgattgactatttagataaaaacctggataacaaagcacactttgataatttccaaagactttgggatgtaagtttagagttgtcctttgatgtgatccaaggtatagtagaagaacttaatttctaccctgatttatcctttaaagaatgcatctctatgatgggcgtttctttgggtggtggtaataaatgggatatcagcagcgttgttattaatggaaaacttcagaaagttagctgggtatctagttggcataacttcacacctgcaatctttttaggtggttcgtgcacactagatgtgtacttgtcatctccaagtgatgcagactctaaagaagcccttgctaatagctcttacgtggtttttgatgatgaaggcgatgctcgaattccattgaatgcgacaaaaatgaaagcagatcttattacaggcggtaaaatcgttgtgtttagtgatgatccagaagattctttccgtattgttctggaaccaactatcaccaatggtgcaactttggcaagcgtgttttaagtaagccagcaaataaaaacccgcttcggcgggttttcttgcattaatgccagatttaataagaggagtagtagatggcagcaccaaaatcatgggaacaatataaagaagagtgtataccaatagcagagagtaagcaaatccaaatcttaggatggacgggacaatggaaagggggccacacaaaacttgatttgttgtgccattgtggttataaatgggatactacaagtattaacagttttaaatgtggtagcggttgtccacaatgtaagagggagaaacaaacaatgtccgacgatcaacatattgcaggtttcttttctacagggaaatttaaggaaggcactatcttcactaacacaggaacacggggtaaaggatgtaggcatattacctggatggttgaatgtcctgtttgctctcatgatgaatatgttcaagcaggtgtttgtgatggtaaattttactctaaaggacatcgccttaaacaagggtatattccgtgtcgttgtgggaactatcagtatacagaagaccagatcacttatagggtaaaaaaggaagtagaagggaaagggtatgtctgggtagattggattaccaaaccctcttctataggtaagtttaaatatctttgtcttgtgcatggggaacagacagggagtgctcgtaatttattaagcctcggtcaaggttgtccacagtgtgctggtcataatcaacagcaattatatattaatattgttaaagataatgatattatagttgctcttaagtttggtatatctaaagatagcgatagacgattaaacggtcaaaatagccgtaatctgttttttatggagcgtatttgtttatatgattttagcacagtgaaacaatgtaaggctgctgaaagagctataaagaaaaaattaaaaactggtattttaacggaaagagagttgaaagacggttatacagaaacagtaagtgtttctgatttggaaaatcttcaaaaaattattacacaatatggtggcaaattagtatacagtaaggagatgtaaatgcggattactgataagtatgtgttcttcttttcagcaaaagatgaatttagcaactggtatctatcatcttttattgaacctttagcccccaagtataataattctattacaagttctgttgaatttacttgtgtggaacaatatatgatgtggagaaaagcatgtttgttttatgattacaacattgcatcttctattttaaccggagatctaagatatacaggagaaaaagaacaggcatattataagcgactaggtagattagttaaagattacgatgaagatacttgggcttctttacgggagaagattgtcaagcgtggtttgtatcttaaatacacacaaaatgaagatctcaaaaataaacttatagcctacgcagatagggagttcgtagaggcaagcccttatgattctatttatggtatcaaaatggggatgtgggatcgtgacgtggaaaataaggattgttggaaaggacaaaatcttttaggaaaatggcatacagaccttgctgtttatctaaaagcacaatctgatatttcctgatattttgaaaatttttatttttataaaaaggggtgtgggtttcatgtacggaaattcaccctctgcacagtatatccagagtaagtagtattctataccctgttaataaagtatttaatttgtttgttggactatggtatctgatctttaaaaggtatactatctcttaactactacttataacagaacagtaaaatcatttttataaaaaggacaaaattatttaaagtttttacagatttttggatacaaattttgaaaatgaaaagttcaagtttggtcaaaattatttaaagtttttgtacgtatttctatccagattttgaaaatgaaaacttcaattttttaaaaattccccagtttatttaaagttttttttgcctttttccgtagaaaaatcaaaaatgaaaagttcaatttcgtgtttttatggatgtgcgtatgataatcattttcatttgtaaatgagaatcattatcatttaagtatgtaagtgataatcattctcactaagagaatgagaatcattagcaaatgagaattttctcatttagaaaataacgcgcagggggggtgtttgtctcgcgctcccgtgtcccctcgccatataataagaat

SEQ ID NO: 5 - DNA, 146796 bp, Unknown
  Bacteriophage genome sequence derived from the Myoviridae family
acacacggggggaaaaatctttgtttttagtgatgacccaaaagtttttccccgtttttttctggaaccaactatcaccaatggtgcaactttggcaagcgtgttttaagtaagccagcaaataaaaacccgcttcggcgggttttcttgcattaatgccagatttaataagaggagtagtagatggcagcaccaaaatcatgggaacaatataaagaagagtgtataccaatagcagagagtaagcaaatccaaatcttaggatggacgggacaatggaaagggggccacacaaaacttgatttgttgtgccattgtggttataaatgggatactacaagtattaacagttttaaatgtgacagatcttgcccacaatgtaagacgtctttcacaaatatgtccgacgatcaacatattgcagttttcttttctacagggaaatttaaggaaggcactatcttcacaaacacagggacacgaaaagagtgttaaggagtaagtatattacctggatggttgaatgtcctgtttgctctcatgatgaatatgttcaagcaggtgtttgtgatggtaaattttactctaaaggacatcgccttaaacaagggtatattccgtgtcgttgtgggaactatcagtatacagaagaccagatcacctatagggtaaaaaaggaagtagaagggaaagggtatgtctgggtagattggattaccaaaccctcttctataggtaagtttaaatatctttgtcttgtgcatggtgagcagatagggagtgctcgtaatttattaagcctcggtcaaggttgtccacagtgtgctggtcatagtcaacagcaattatatattaatattgttaaagataatgatattatagttgctcttaagtttggtatatctaaagatagcgatagacgattaaacggtcaaaatagccgtaatctgttttttatggagcgtatttgtttatatgattttagcacagtgaaacaatgtaaggctgctgaaagagctataaagaaaaaattaaaaactggtattttaacggaaagagagttgaaagacggttatacagaaacagtaagtgtttctgatttggaaaatcttcaaaaaattattacacaatatggtggcaaattagtatacagtaaggagatgtaaatgcggattactgataagtatgtgttcttcttttcagcaaaagatgaatttagcaactggtatctatcatcttttattgaacctttagcacccaagtataataattctattacaaattctgttgaatttacttgtgtggaacaatatatgatgtggagaaaagcatgtttattttatgattacaatattgcatcttctattttaaccggagatctaagatatacaggagaaaaagaacaagcatattataagcgactaggtagattagttaaagattatgatgaagatacctggacttctttacgggagaagattgtcaaacgtggtttgtatcttaaatacacacaaaatgaagatctcaaaaataaacttatcgcttacgcagataaggagtttgtagaggcaagcccttatgattctatttatggtatcaaaatgggaatgtgggatcgtgatgtggaaaataaggattgttggaaaggacaaaatcttttaggaaaatggcatacagaccttgctgtttatctaaaagcacaatctgatatttcctgatattttgaaaatttttatttttataaaaaggggtgtgggtttcatgtacggaaatccaccctctgaataatatatccagagtaagtagtattctgtactctgttaataaagtatttaatttgtttgttggattatggtagctgatctttaaaaggcatactatctcttaactactacttataacagaacagtaaaatcatttttataaaaaggacaaaattatttaaagtttttacagatttttggatacaaattttgaaaatgaaaagttcaagtttggtcaaaattatttaaagtttttgtacgtatttctatccagattttgaaaatgaaaacttcaattttttaaaaattccccagtttatttaaagtttttttgcctttttccgtagaaaaatcaaaaatgaaaagttcaatttcgtgtttttatgggtgtgcgtatgataatcattttcatttgtaaatgagaatcattatcatttaagtatgtaagtgataatcattctcactaagagaatgagaatcattagcaaatgagaattttctcatttagagaataacgcgcaggggcggtgtttgtctcgcgctcccgtgtcccctcgccatacaataagaatagcataaccaacaacaaaagcaagcgattatttttatctttacatttctttacaaatttattttagacgagctaccggcgatcaaccttccaaccagtgccccctggtatgttagccccgcctttacgccgtgggggtggcgcttcctcttctgtatgtaaaacagtataagcccgatccctgggcttgtcaagattattttttgttttcttgccaggaaaggacacctaaccaaaaatacatatcgccccgcgcccctggtggtatcttgctttccccgccgccactgcaagcccatagatagccattggcgaacggatcaaaatggtctatctcttccaccttatgatcgcccaggttgagaacggtttcaacctttaagcccgttgcgcttgctacctggtgcaccgtgccgccttgccagcccaatgagtgcatgagatgtaaaggagtatttgtcatggtatcgccctttctttgatgtgcgccctggttggcgcggtagaaagataatagccgtttcctttatagatagcaagcaaaaaaagaaatgaaaaaagattaaaaaaatggttgacgttaccagggtaataacatattattcatcttgtcgaggggggcaaggcacaacgacaataaataaaaggcgggtgcaatgcaggacgggcaaaggtgaggatctccataatccaccgtcacaataacattacttataaaaggttgataacgatgatcaagaaagaaaacagcttgacggttggaacgattaacgctatcattctagccgttccattttggattgtagtagcggttgttattttctaaaaaatattcttgacaacgttttttaatctgataagatgtatcacatagggcggcaatagtgccgctcataacagaagagagaaataatcatggcatcatatagcgcatcaatgatcgtaacgggcatgactggtaaacctatgcgcggtggcggatctttcgctaacatcaatattgatgggcgtttatccctggatgcagcgatcaccgtggcacgggaaacatttaaaaaagaatgtaatttcaataaacaagattatctcggcttcgttattgaaaaaaccgcgcgctttgtagattataaaagcccgaaaatgatcgacactacactaaaagcgcaagatgtagcttttttgctttaaggcttgacactaaaaaataattttgtaatatataccacatagggcggggaaatggtttcccgccaaatcaaagaaagggtaacacaatgagcaagcaaatcaatactatcatgttaaacctggtatctttccgcgaagacgtgaaaaatctttcgcgtgatgcagtggatgcacggatcgaaagctatcgcacacagatcgcaactataccgataaaacgtgatcaacatgccgctaatatgatgctttatgctatgtttaaaaagatgattcagtgtgatcttaccctggcttatgaatatgctggcgatctctttgtaacatataaaaagcccgtcccaggtatgagcaccacagaagaattgcatgccttaaatctgcgacaagatgcatgggataacatgcgccgtgttatggtatgggccgaaagcggtaaaatttacgaataaaaacggttgacattgcacgaaaacctgataagctatcttaaagcgggaactgttcccgcttacataggataaaactttatgaaacaatatgtaatgagtattcacaccaaaaacggcgcttctgttacgactccggcacggtttgcacttgtaaaccgttgcaagagactaaaacgagagataaaaaataaccgtgcaacgggttttaaacgctggggaggataatcttgttttttctaaaagtttgtgataatgtgatcgcttttgaacatgctaccacgttcgacctggcgagatacgctatcaggtttaaatataatgtttatccccgtgctggcggcggttacactatttttaatcatcgaaacgcacaaataacagatataacaaatccagatcctggagtgtatcggataggctggataccgtcaaaagacgccgcaagcatgtttaaggtgtgtaaactactaacagaagaggcgaacaaacatggggcgtgaatatgtgatccagtcctgggtaaagcatgacgctaatgatccgcgcataataccagatgacatgatcgatcacatggtagggtagagcggggagcagataggaaatcgagcggcaaagagcaacggacacaccaagacgcgatccgttcgccctgggtggctggcaaatggtaacgctgacattgcaagcgccgcagatccaagcgatgacgctaaaaataatcccttatagagcattgatccggcttttaaggtgttagaagagtatcccgctaaattagccgcactagaaaacgcatacgaagaaaagcgcatggcgtggactgtatacaacaccgctaaaatggtgctagatgcaaaaattattaaagcccaggagaagatcaataaacttgttcccatagcgcaagaggaagaccagggcgaccaggaggaagaggaagaaatcatgcctaccctggaagaggaagagatccagccatacatgccgacagaagaggaaaaaagacaagccctaaaaaattatgaaaattgtattgtgtaaggcttgacatatgcaaacaagccccgtaatatgtaccacataaagcggggcaacgccctataaggtgaaataaaaaatcacttgacacctgaaatcagtaagctataatgcttatatagattgaaacattactaaggaataaaagcatggctattattgcaaagactgagatcgtaggtttagattctatcatcctggcatatgaggaagctatagaaatgtatgtggtttcctatggtgattatatccgtgaatataaatctattgatctagcttttgaatgctatattcgccaggtcaataaagcatatgatgattatcgttaaaagttttagtcttgtgctattgacaacgaacgatagtacaagcataataacttttatcgggaatactcctaactaatcaaaagagattaaagactatggctaaaaatatcaatgtttctgcttatgctaccctggctaacactgctaaaattgaactatccagcattgaagcggtacatattcacgcccgtcgctggtttcaaaagtcttatggtaatacttatttctctttgatggttgacgttgagatcggcggtaaactgatagatgttgttaacgttccgtttcaatatggatatggagatcattttgataccgtcgccctggaagaatttagcaaggttataaatgtggaaggtaaagatttttcaaggcgcgcatatctttcccgtttttgccgtgaaaatgggatctctgtatacagtcatgcaagcgatgtaaaacgaaaaaaagatttataaaaagcattgacagcacgaataaaaagtgtaaaatgtttcatatcgagaggggggaagggtcccgcctcactgaaaaagagattaacatcatggataaatctaaaatgttcttaggtcaaaaaaataaaactcattggaatgtaagcctttggattaataacgatgaatcattataccggctggcgaaagaatttatcgccgctaatactaatcgtaatgatgctgcccgtgatatgatgttattcctggagcaaactggacaagataaaacaccggacggtttcaagtatagcactacagcgatccgcgccgctatggttggaatgtaataaaagcagttgacaacgttttatattctggtatagtttatcacatagggcgggaaatggtttcccgccaaatgaaagaaaggttatcattatggctatcgttattgttcgcgtatccggcacggttggaatctcccagggaggagcagttctcacagagaagaaaggggatgatcttcactcttccttgaatagctgggcggtcgctaactttgggcaatggtcgagcgttgagtacatcgaatcctaccaggtgccaacgattagcctgaccgatctcaacgttgatcgtctgttatgcctggatcaattaaactaaaaataatattgacaagacaactaaaattagtaaaatgtaattcatagggcggcaatagtgccgcccctagtaagagagattatcaaaatggctaatatccgcaccttgttaaaaaatgcaaagcaagttttattttcagatgacgagtatttcaacaaagacattacaggcgtgaaaaatttaaaagatgtgaaggatgttatcggtatccgtggatctttacgtaaaggtgacatatacggtaacaaggtgcaatataaactgtcaaaagattatgattttactttgacaattatttcataaaactacttgtaaacctggtaaaataaagtaaactatattcatcaaggcggtggaatagcccaccgcctaacaaagagaagaggaaaacaacatgatcattttcgctacccgtgaagccgctcgcaacgttgcacgtaaagttaacgccgccaacctgggcgctacgcttaaacccccggtgaaagatgaatcaggaaaatggatctttcctggtctgcgtcacgctgataagctgggaacattaacgttaaaaaataaataatatccgcttgacagtagcatcatttataagtaaagtaacaacaacggcgggaaatggtttcccgccatcaataaagagataagattatgaaatcagtaaaagcaattaaaacttacattgtgtcggctattttttttgatggtactacaaccaaaaaaaaaaaaatcaccgaactgatgcgcctttttaactctgaatactggtatcaatctaatcgtgatcgttataataacaatatggtacaagctgttaaaagctggttgcaaggtttaccgtcagatatcaatatcgcttttaattataacgagatcgatcaattattaattgaatggaagtacataaaagaaacaagcaaagaaacaaccgttacccgtgagcgggaaaattattggttatatattgcaagcatgatcgtaactttggaaaaatatcataacgtagcgtaatcgagaggaaaaacatgaacgcatcacagcagatcgaaaaattcaaccgaaacaaagcgcgtaaagattggaacgaagagatcaccaaaaaaggcgacaagcggaaaaaaaaaaaaagagatcgcagcacaaaaagatactggaacaaaaaaaaaaaagggggaaaaaaaccccctttttgtttttaggggggttttttctctaggggaaagggaaaacccggggaaaccccaaaaaaacactttagagggttttacgggagttttaaaatgaaattagaagaaaaaagaaaggcactaccccgggggaaaaggttatgcccccgataacctgataaatagggtttcaaaactaggggcgtgacccgggggtttaaaggaaaaaaaattttttttgacactttaaaaaactttgtatatagagaaaataaaatctaaaaaaaacatatatggggaaaaaaaaaaaaaaatttttgatcgcgggtttaatcttttttgggagggttggaacatctcgcggggacataccccccacagtagcaaaattaagcccctttgatgaaagggaaaacgtcatggttattaaaaatgcgacccccgataaaaagaggggggttttcacatgtgatctcttggggttcttttacacaactcgcgaaaaaaatagaaaaatcttttgttaatggctaaaaaaaagatgccccgtgaaaaattatccccgtgtgtataataaaaaaaattttacgccgtggttaaaaagtattcaaaaagtacacagtacagccgcagatcgtagcaatgaaaaactagtgtcagcacttgcaacgtataccctagcaaaatgcaccgaaaaaaaagattgacaacatagaaagcacgttataagatacacacaacaaaggagaactacatgaacggcatagctaaaactttttttttttgcgcgggtataaatgacccatcaataaaagtcgatagtgtaaaagaaaacaatactatcacagctaaattttttaaagatgaaacaaataacgtgctaatcattaatcttaaagaaataaaaaaaggttattatactattgtttaccatgcgatctataatgctgatactagtgagggagcacaaacaagaaacaacgaaagcggggcgctacctggttatcgggtgctgggcgttctctttttaattgtcaatttttttttttaaggaaaaaaaccatcccctatttatttttttttttcggtatcttattgacaggattttttttcttctgtatgcttggttctattgtaaaccactttttaacacattagggaaacagcataaaaatttttcccgtacagtatagcattataattccagtatatgaaaaaaaaagaaaaaaacgcatggttttattttgtattgctactataaccgtgttgttatactttgtgttttaataggttttatagttgtacgctttaaaggcttgacaattttttgttatgctttaaaatatatcttgaaaacggcaaaggccgcaaacaaaagggtaaaattatgaaatctgtgatcggtgtttatttggataattctgattttttctatcatcgtgcgcgtttccttgatgctattgaaatgatagaatcaggctttaaagaataccgccttgcacatggtgacctggaagtattagagggaaattgtttttttacattgaaagcaaaaacactatgaaaaacccggatagatattgcaaaaaaaaagagagagcgcggcgtgtcgtggttgcgccccgcaaaaataaacggggggaaatggtagggcaaaaatttaaaaaaaaaatatgcttttgtcaatgtagaaaatattgaagattattgattgacagcacactgaacggggagtatattgtatctcatagagcggggaaatggtttccccgccttaaaaaaagagaaaagatataaagaacacaaaagcactttccaactatgcagcacgtcgcggattatgtttaaccgttgaaaatttagggaaagaagattttttgtgcttttgggagcttgagaatgattgggagtggtttttttctttttctatctgaaaagaaaaaaacgttttttattaacctggcgcggtaatatctatctaccggaagaaatcaaagaagaattgccaggcacgatcatgactgagaaacagcttaaggaagtgattaattttgtagggcaaaacattaaaaaataatttgacactaggcaaacaatgtagtaaagtttatcatcacagggggcgggaaatggtttcccgctcacaacaaaagaaaacaaaacatgatcccgactatgttttacgtatcgcgcaaaggtcacaatattttttggtctgaagatttaaatgaagccatgacgtttgcccgtgatcgtgttgctatcggtggcgttaacatcaccgtaaccgatgaaaacggcattgaacactataacggcgacgatgaagagtaattaaaggcggggagtattccccaccgtcaataaagagataaatcatgaaaactttcaacgcaacagcctcgacaattggttatattattacagtgcaagccgtggatctggtagcagcagcaaacaagattaaaagaatgatcccgccaggtagtgaattttccgtttgggaagtaaaataaatcttgacaatagtttattacttgatagaatgtatttcgtagggcggggcaataaggcaacgcccattaatgagggtaaaatcatgttagagaaaattttcacggttgtagtagtgggcctggcgttatcggttggagtggttgcaactatggctaacatgatcctatcttcccacggtattggataaggtgaatcaaatgatcacgaataagacaggtaaaacagaatttttacgcggcttgcagatcggcaagcctgaaatctggcattgcactaaaacaccacgtgacgaaatgaaagatttcaccgctactttacaacgtgttaaaatatctatcacacagaaaaaagccttgttagtagtagaaaacgagatcccgcaaactattattattgtcgagcgtacagcatgaaaaccgaaatcattattgaaatcatcaacggttataaagaagcctttatttttgctgaatcagccagggatcatgaaggggattttattgataacttagacgattatgatttttcagatcaagcccatcagcggatcattcatgacgtagcggcttattgtgatgccaatgatgccgctatctctgaggcaatgagcgacggcgcaacagcgaaccagatcgggaatgatttacattttacccgtaacggtcacggcgtaggcttttgggatcgccctgaaatatacactactaacaccgccaaccgcataacaaatgcagctaaattaatgccatcggtgcatgcttacaatggtgaagataatttgatttatattgaataaaaagtattgacaccgatccccaatatggtatgatttaccacgtaggcgggaaatggtttcccgccaggtaatcaaaaaggtaaatactatgcgcaacctggtttctgtttctaacgttgaaaaattccaatctttacagggtatcgttaacaacgtagcgccttttttagtcaacggcttgattgcaaagatgaaaaataaacatcatgcagcatggtctgcttactgctttgataatgatgaaaaagcggctgaaatgatgttaaatatgctgttagacagtgtagaatcatctttaccggaaaacatcgcagaagagatcacctatcgttataatatggcgatcacttaccaggaggttgcgcaatttaatatgatggacgatgacgaacaacaggatcaggaaatgttttgggagtatgctgatcgtcaatcggcttttgatgaaaaattagcgatgtattataacgaatattaatacacggtaaaagaaaggggcgcactaagcgcccttttttgtattcttttttcacgatggaaacaacacgtaaagaataggcgtaaaggtggcgtaaaaccatctaaaaccgactgtaaccgcttaaacaaggtaggaatgattaatcaccttaccaggatgaaaaagctgttataaagctatctagagcgtttaaagcacataggaaataatttgctttttatcttgccttttaccctgcttttgattattattatggaacgggtggcacctggggacaggggaagataatcaccggaagatcccgctatatattgatagctaatacctattaaacaacaaaacatcaaaggaataaactatcaaatctttacaatcctacctattgacacacgatcacccttatactaatatgtatcgcgtaggcgggaattggtttcccgctagatataggaatcatatcatgatcgaacaaattaaaagcactacaccaaatgttaacggcaatgtttcacactttatcggtgataatgaaaggggaacaccatacgccgccgtaaccgtgcaacctaatggcgattattggtttaccgtgtatggatcatactctttcggacgcccagcacatgataagatcttgcaagcggttaaacctgcggggaagaatattacagcagaaaaattttataaaaaatagcttgctttatttcttctgttaacttatagttatcgcgtagggcaaacaattttaaacggtaaacgaggaatcacatgagcaaaatacacagacctggcagcgactgtaaacggtaaagattttaacggcgctgtagatcgtgatcctatgtggtgcttatcagtgtttaaaggcgatctggttgaagttagaacaaccgaagggtatagcgatgattataaatgcgagatccatttacataactggtacacggggaaaacttatgcgctgaatcacgcgtttatcgggaaaattgaatatcgcgagatgatcgacgatgaaacagggcaagattttagcgattatgtttatattcgttcagaaacattagccgaacgtttgatcgagaaaatgaaagcaaaaaataaaattaatttatctcattggattgatataacaaacgatcctgcttatcagtaaataacatttcataccagggcgcacaaagcgccctttctttttacctaaataaagatgatagcttttacctatcaaaaacgttcaccgaaaaaagtgaatagatcgcggtatcgagctaatcaaggagcagatgaacaaccataccatgaagatcataaggcgcttacaacgtgttttagaccgcttatttttaatttcttcgtgtaactatcgggcaaaaacagcctttttcttatctttcctcttaaatgataatcattcttatttatagctgattatttatgcaataaactgcataatgcaataatgataatcattcttaacttatgaccatctaacctataaaataataagttatctaactaaattaaaactaattatctaacctttatttataacttactgttactatctcattgataaccttatattaaacaacaataactaatataaatcattactaagctaactataatctatctaacccttaaaactataactataatctatcaaattgttgcacaaagtaactattaaattgttagtaacattactaaataattcatatcctatctatttatgatctaatctttaccttcctatctattacctaaataatcatttcatacaataactataacaagaaatataattagcaagcgtatcattagcagcctatgccggacacataggcggctaataataacgcaactacacaccccacataataaccatcaccgatagttattatttgtgcttatgtagcttgcaacaactgcaagcgcaacaatatacatggtatattgtatcccttacattgttgcggtgcgttattattagctaatgttttgaacattggctataatataagctaaatataataagctatacaataataaacatcgagaataatgataatcataatcataatgcgccaacttccaggtgtcgctatgtgaacacaaagaaatttttcttgttaagaatagtatccctatttgttgcaatataaattattatttcttgcccctaaaaattaccatttgttgagcctactttcttaaaagcgcaataaatcagaattatcttgatttttagttagttttatagtacagaaaatatgcaaatgataatcattatcagctatcttccacgggtggcactatttcactcatgatcatttcatttgtcaaggtgtatatagatgtttacaaatgccaagccattgatttacttagaatttatctgttttgttgtgagtattacctttcttgcttagaaaataatcaaaagtcttataagtcattgaatgataatgcaaatgataattattctcattgatatttgagggggacggtcggcagaaatcgggggggcgctgaaaatcgcgttaagcacctctcgcaagcgagcagtattttgcggcaagttattgatattattgactttacgcttatgaaaaggggtgtgtcgaaataaatcgggtataccggaaaatttttgtggcatagatatttatttgtctatattatgtacaaaggggtgtgttaaaaataataggtatatatagaataattgaatactaatccctatactaattcctccattaatgatgttcctatgttgctgttcttgtaacagatgaaaagacgctgtatgatgtgtggcatgagacgtaaatttataaaggagtctgatatgtgtgttcctcttagcagtccactgctgttagaattttacaaagcatggatggaagatcattcctcaatgcatcgtgagaatgttggtttgtgtatttgccttatggattatctggcaaccactatgtcaaagaaaaaacctacgcaagaagatatagaacatttcaagatggttcgtagtaaaacgttagaagagatgaaattgcaattcacgtgtgctgggctatcctccttcctgccctttaatgatgatcttctgtgttatgaagatgaaggtaagaaacattcttgccatactaacccagagagattgcagtgggtgaaagatcgtattgccgattcatgtttggtgttagggggtaataatgaaaagtaatattccgttgagtagtgcagctttaatacgattctataaagcatggattgccaaccatcctgcaatgaatcgcacaacgagtggcttatgtggttgtctggtagattatgtagatgattttgttggtgaggtaactagagaagaagataaaagatggcgtgatcgtttgttggatagtttgaaatacgaaatgaggaaacaatttacatgtgctggcctctccttccccctgccttttaatgatgatcttttgtgttatgaaggtgaaagtaatacacgtccttgccataccaacccagtgcgattgcagtgggtgaaagacagaatcgaagatgcaaataatgcttgcattgaatagaaatgtctgtagactgtgttccatagcatatgcaatatcgcgcataacaaactactaatgagaggtgtaaatgataactgtatctttgtatcttgctaacacggagcgtgtacataatctagtaaaagaatgcggtgtgagtgttcaatttaacacaggaacgccttccgtggtgacaggcagcgatatgtgtgttattgatttcatcaatgaatattttcgtggtaaacctattgctcgtcacttcattctagaaatgcgagatgtagaacaggaatatgaattctacccagaaatttgtgaacgctatgaaactattcttagttctgtagaagatccagatacaagtgaaacaggtgattcccacttgctgtggatgttgaatgaaattcaggatgggtgtaatggtatgtctgaaaccaaacgccatcgatggctaggctatattcagggtgttatggttatgaaaaaccttattacagttgaagatgaacgtaaagctacacgccctgtctttaatggagcataacatgaaaagcatttaggtgtgtattgaaaataattgtggctatctgggattgacacatgtcgctttccctcttattttagatgccgatatcgcttacagcggagttgcttatgtgtcattcaagacaatgagccaagtacctggctggaaatgggaagttgttgatgttgttgaaggagaagattatgttttccttccacacgaatatactgtttaaaagaggaaaagaagatggataaaactgtgtacttagtaacaaagatgaccacaggtgtgagccaatgcagcactgtaccttacaaaatctgtgcaacactagaactagcacaacgtgcagaagcagaagtgaatgccatgcaatacagctatggtgaaatcattccttttactcttgaacaataaggatttgtgtaatgtttgaaattggtaaagtgtatcgttttaaaaacccatcttatatccgtaagtttgctaacgtgtctgagtgcaatagcaggattgcttcttttttaggtgattcctattttcgtgtattagatgtggatgattggtatggtgtcactgctttgcaatccttagcaggagaacaagaaattatcgctcaaaatgaaggagactttcttcagtgttacacgttgcttgcaaaaagtgagtttgagtattttgtagaagtcttagaggaagcaccaaaaagtaaacacgaagagaaatacctgcttgtagtggatggagttccgatcatggaaaccatctcccgtgaggaagttgaaaaagaggcgaaacgttacaagctggatcgcacacagagtgtagttgaagtctattctcttgttggtgttgcagatattagtgtgaacatcgtataatatatgtgtaatgacagatacattcttcgtgtatctgataagtctcctatgtttgactggcggggctggtggctactagctccgatgcagggtttgatagacgtggaaaaggaggcttatgtgtatacaaaagaagagatagaagatagtctttatttgacagataacattaagaatggtatctttgagtgtaaattgaaaggagaggaagaatgactattacagaaaaactgcgctgtattgcaaagcaaagtggagaaggcttatggtttcctattgaggaaattattcaggactgttatgatcaggctaagactggcaaatactccaaagcatttaaaccgtctgttttcggtttggatgactatccaaaaaatgaacaagcaaagaaacgacaagttgatttgattgatctggctatggaagcactacgagagcatgggcttagtaaggtgtatgctttaaacaccaaagagggctttgtagattcagtgatcgtagactggtattaaggagaagtcatgcaagagaatagtaaagtgtgtagcatgaaaagcagcccctatttgctacaattttatgagtggtggttagaacaagaagatacaaactttagcaaaaagcattatggtctttgcacgtgtcttgtagacttcttatacaatattgctttgataaaagatgttgagaatgtatcaaagctccaatcctctgtacgagaggaaatgaaggaacaatttaagaaagcgggtttgaaccatttacatccgtttaatacggatttctcgcactactttacggaaacagagctaggcattgcacaccttaataaagaacgtgtacaatgggtgattgatcgtattcgtgatatggaggaatacaatgattaagtttaaaactttctgtgcaatcactgtttgtcttattcttgcatacgtgttattctctagtatcattcgtttaggtgagtatatggcaagagaagctcgtgaaagtgaagctaaaaaagaacagtgcatcgtgttaaagcaccaaagggatgctgaaaaatttcttgaacaggattgtgggcgctatgtgaattataattaggaggggagatatgttagatatttttacctttgatcgtgttggtacaccgattaccgaagaagaacgtaccaaaattgaacaagaattggatgctttacgtgcgtctcttacagacacagcctcactacaacgtgaagctgcacatctcacagagatcactggtattcagtggagcacggagtgggttgtaattacaattgaagcggatatttggggacatgaagagacgctacgtaccggagtagtaacggtttggtgatagatgttattcttttgtgtttcttgatatataaataggagggtttatggtaaaacgtctggaatgggatgcgtgtactgctcacgcttgtcactgtgatattgttgaagatcctaatggagagatggtgtattatgaggattacgaagcattgcataatgctgtgatcgctttactggatgatattagctcacgctatccaggacaacagtttacgtgtccacatatccaactattagccaaacttacggagtacccaagtgttccataatatgggtgtccctgaacaactactctttattgtaggactagtaggcttattggcggctggagctaaagccgcttctcacacgcatcacataatgttaagatttctattcctgctcccttctatcctcgtactactagtcatactgatcgataacatttttcacaattaaggagaggctatgagtaaaattataccaagcagttatgaattattgcagttttatgtatattatatagactgggttaatagatcgaatgttaaagacaatgcgatgtttagtaaaaacatctgtttaacagaaagtatcttccgttactggcacacaggcagaaagtgtacacacagtgaagctatgcgcattgtaggagaatatctggagcaattgcaaaaagcagaacttcctgtccttcacccattcaacgaatctaaagaagaattagaacaagagtgtagagaaggtaagtgccatttaaatgaaaaacgtatcgaatgggtgaggcaacgtttagccgatgcaggaaagactcctagtgactctgactatacgtagtatgatgtagagggtttagttcaaggttttgaggcttgtgctatagataataccaactttgccaaagttttatgcgaggtgtatgatctggcagataaaatccgaaataacggatggaaacaagagcataaagaatcatatgaacgccttgacaagattttcaaacagatctattctaaccacaagaagatgttccaaatggaggatgtgtaatgaaagagattatgtttgaagggcatcgcattgaattgctaaaacacgttaaataaggagagtaagatgtggtctgttaaaatcaaatataatgcacagtattatggtggacaaccttatgaagttgttatttgtgactgtatctctaaagaagttgcacagctttgtggcgctggtgttagtgaagctatgaacaaaatgcataactctactgtgcgttacctggatcaagatattccagaagatgtaaatgactatgcttacgaagttatttacattgaaggtaagaagctctctattgaagatgcacttaaagcactacctgctatgtgcagcccaacaccagaagcagttaaagagattttaccagaatccaaccccgatgaatatgcctctatggttgcttcagatatgtggaatctctgtcgagaaactatgattaaaaatcttgtggaaatggcacatgagtaaaacacactttatacatccgtttgatccaaagaacaaggcggttatacaccgccgttggactgaaacgcgcattacaaaatgtcctgtgccagcagcacaggaatataacaaaacatataaagcagaatttgtggagtacacctttgtaaataacaaagggaaggaggtttatgttccagaatactgcctttggataaaatgggaggaataatgcaaacattttttatcgacaagttcaataaaagtatgaacacgtggatggcaacattcactatgcaatttgcgtcatttaaagaagctcaagaatggtgcgatcaacacaaggattttgatttttactatcaagttaatgcaaacctttctccagaggagaaataatatgttagctgatattgaaatccttatgtaccgacaaggtatgatcaaaatgtggctagattcttttagcaacatatactgcacagtacgatcagcagacgagcgtaaaacgcttattttatctgctattgttgataaacaacgtttcttcaaagaaattttgcaaacaggcttctccgatgcaggagtagagattgcaacgcttagtcttggagtgctatcttacttggaatccgttgttttatatgtcttctctttagaagaacacttgcaatttgaagcattaaaacttatcttagatgctgcaattgacatagaacaaaatcgaattgattcttttgaataaaaataaggaggaaactatgcaagaggttaaacattatccacatggtcgtagttttgtagctgtatggcatgttcctgctcgtaatgaactattttgcgcatcttttcattacaaagatggacaatatttcacctatgacgagacgatggatgattttatcccagagtgcgatcatgggtatacaccaatgttctttaaacgtatgaaagctcgtttcttcgttacagatgttgatggtgaacctacttggcacatcgaagaagattggcaagattctgtagatattaaagaagccccagaatgggctacactactggtacacgtcaaaacccctactcttgacgttatggcgtgggttaatcatgatgatacccattaccaatacataaatggtagcacagagatttctggtgagattattggtcgttggaagcctacgaatcaggttgctattgtcgggtataagacagtataatatgaaaaataatgtagattgggatgatttatccgattttgaaaaatggttcttaggtagtggttgttatgcagatggggatctcgaaagagatccttctggaaactacactatgccattaacccaaggtttttatgagtgctggtgcgcagcacaaaacaacgtactgaataaggagacaacacaatgcaattaaacatcggacaacccatttttgatgcagatactggtcaatatgcagtgattgttgctcgtatgagcggtgatgaccttattgtttcagaactactcggatcagatccacaactgcgcgtagtatgtgacctatatcttcgagacgaaagtgatcgcattgcactgaaagaagatggtatgctctactatacctggactagagatcctggggtaacggaggtagaggtataatggtaaggaataggggtttacataaaagaagacaccttacttactggcatcgtaaagtacatgaatctgtatcaaagaaagaatggcaatatctgccttatgggaaggagcgaagaaagtatctgttagctcacttaagggtacatggttctcttcctgttaacagtaagtggcaattgcaaacagcttatgacgaagatatgaaatatctgttaaagagaggtattatttgccttgttaagatgggacgatggaaatctcgtcaatcttatatcgtacttaaacaggagaaacgatgaatatcaaagatgttgtagcatacgtagaagatgaagttaaaaaccatacaagtttactgaaagtaatggttgtggttaaagatggtattggacaagtaaacgtacaacatgtcttatctgacactgtatataatgtgtttgaatgtaaagaaacacctcatggagtacgtgtggtttatattgataacaatttcaaagaatgtgtgagacataccttagaaaatgaactaaggatcacaatcttatgagttattatgttgtaccttatgccaataagtggagagtaagagaaacttgttttctattctcctggtgggctacgttcggagatggttgtggaaatgatacaggaaagcctgtagagtacgacacaaaagaagaatgtgaacagtggataaaattaacacaaagatgttgacacgatcttaacttcttgttagtatcaatgtgtactaacgataaggagggtttatgaagtctgtaaacaagttgcaacaatttttgttatcaacagcaatctctttgcttttgttaattggtattctgtatggtgcatctaatttgtacaatctacataatgatgtagaacagaacaaagagaagtgcatcattctaaaacacaataaacaagcagaagatttcttaaagaataagtgttacaactacattgattatgaggagacaaacaatgattaaagaattaggtatgcgagtatacagtgagtggactccaagcaatggcccaggagttgttgcagctaaatgtatcaatggtcgtattgagtacctggaagggtatgaagataatgaagagttagtagattatgctaaatcttttattgaagatgatacagactttattgtattatatgatacaggagagttagagtatggatatgatggagatggggatatctttgaacttcaataagagtaataagtaaggtataaagagtatatagttagttatagagttagtaacattacatatactctttccatgtataacatggaatattctctacctcgctatcgctcggtatataagattagggtagcatgttttttacgaaaagtaaaactgtttataccgattgatagcaggtttttaatagattctatctatgaggagtagaaagtgtacaaattatataaaggaaaagataagtttacgggtaatacatctggtttctatgtaacaccacgtggtgttgctgtatttgattggattcctggtactccagatcgtgaaatgatttctcttgtaaaactgtcggaacaagagtacacttacggtgacattacaacgttctattctcgtgcagaaaatccaaaactgatcgcggagtgggaataatggttacacgatatggtttagaggtgtacagccaaggtgctgctggtcaatgtgatattgtaccagatccagaaggagactatgttcttcttgctgattacaacaagctagaagaaagacttctggctgtgtatgctaaagagaacaaaacaatctgtccttattgcaatggaatgggttgggtggttgcagatgttggacagatgtatgaatgtgtaccttgtaaaaccacaggatttattgaaaaggatactgacaaatgactgtagcagataaaatgagagaactggcagaaaacgcagaacttaacaaagcaaaggagagtttacaaaatatctacgcgtatattgagagagcagctaaagatggagacagagaagttgctatatacacgctttatccaactttcgcaaaagttagcttggatgctgaaggtttttcaacttttattgatacagaaacatctcattacgatgaaaactttactcgaatagttattcgatggtaaatttctgatatttatgcgccctggctacctgggcgtaataaattcagcttatatttgatccgcgccttcggcgcttaggcaaagccacgccacacaggagagtttatgttcaaatggttaaaagagtttctaacatctttggcagaacctaagcaagatgttattaaaagctctatcacaggaaaaccgcttgttatagttacaggcggctttggtcatgggttttctcttaaacaaacagatataggtttacagggatgtttgattagctttagaatcactcaattaggagataatagacaaacaatcttagaccttttcaatggggaatttgatgactatttatccaagagtggtaaagaacgtctgatcgaacatataaaacaccgctataagcatggtggttactacttagatacaaaacgtaatgcacaaggtgatcttgacatagttcgtatagcgtgggataatgaatttaaaattaaacttggtaaacttctggaggaattatggtaaatattaaaacaggtgatattgtacgtcttgccagtgaagaaatgttaatgactgtaatggtatctacctatgatacttgcgaagtggtatggtttgatgttaatgaacaactacagaaagctacatttgataaacgtatgcttcgtaaagttgaagaagtgaaggaggaagaataatatgacaatgttgcttcgtatgtttgtgtttcttatgttctggattatcgttggtaacggtattgtgtttttgatttttcctgaagtaatgacaggtaatgaaaataaggcagtgccttacattatgcttatcggttacggtattggtacacttggattactgtttgctgactggttagtcaatactttgttctctaagtacaggaacaactgatatgtcggaaaaattacctaatgttttcttttgttttgtagattgtgttacacaagaaattatagttgacgaagaaggtatgtttacttattttgcatctgaagaagatgcaaaactatcagctatgaaatgtataagccaattgtcagtacctgctatcaacaggttcggtattgcacaggtgtataaaacagtaacagagtttacaccagatcgaaaactaacttttcttaacgttcactttgtttgtaagtttagtgaactacgacattaaatcaggagtaaaaatgaaagaatattggagtggtgagaggggcttactaaaaccaggaatgcttttgcgagtaaagaacatgttgatcacacaagattacataatgcctaaccctggagcattagtagaattccttactgagcgagatcaacctggggttggtgaaatgtggattgtaacgtggatatctctcgatggtaaattgcgcgttgctcctattgacccaaaacacctagaatctccttacgccagtattgatcctcggatcatagatttggctagagtttataaagctcggactggcgtagaattaaatgtggaaattttaaatcaatgtattgacttcttaccggaaaaagtgcataatgcacaacaagaaggtaacggtttagaagttgttcttcttaatgatgggatgttctctggtttggcatccgtagattttccaataacattaagattgttacctggagaatatgtactggatgaagatactattgctatatcctctaagattttagaactcattccaggtgcaaggtgtgttggtgatacatcttccttgctgtttaccctgaatgaagaagccattatagttaaaaaggagaagtaaatgatgacgtttattgttggtgttgttgttggttattttggtcacaagtaccaagatgttatcatcgctaaagttgacgaagtaatcgaaaaatttaaacactaattttttaaaaggctgtactgctgtgcagcctatctttcaaaggagagtaaaatgttcaaagataccaattataaatgtgtacattgtggtaaatcttttggtgatcacaaagctaaaacattcaattgtccacgaaagggcggggtagctttaaaggttttaatccatcccacgtttattctcccaactacgagaaaccagaagaagaaaaatttgtaatctgaggaggcaatatggaactagtgcaagaagtttatgaaaaattgaaagaagagaatcttgattggcctgaacatgctcttattgtcgtcaaagatactaatggtgaaataaaattctcaagtgtaagtgaagatgatgttgttttaagtcctacaggatattatatgagaggtgttacgtgtctattcaacaccaaagtgtatcctgaaattaaacttagttacggtgaacctgatcatccagaaatcgttacacgtaatgaatatgaaaattattattttgctcgtgaaagcaaataaggaaaactatgcaaaaaataaacactggttctcgtcctaaacagaagcaaacaaaagcaagggtatcttatgttgacaactcttgttataatttcaaaaatgttaaagaagttatcattgatgaaaaagaaggtttgattcacatttcatctgaacgtttgaaaggtagtgttactcttcgtgagaatgtatctatacctatgaaagttgtggctacactctgtgttgataaaccagatgttgttaactactatgtgttccgtgatagtcgtatttcattacataataagatttttaaatcttcgcacgttaaaacaaaacacattgtataacacataaacccgcttcggcgggttttcttgtatgtgtgttctttatttgttataagtattttcttagcataaacaataggaggtattatgtctgtagttgtagaaggtagtattggtttcttagtagataaccctcaccctttcgtggttaaggttcatattcaagaaaaggtaagcaacaatacgtggttgtgcttgttagatagtaagatacactcttatacagaggtttatcttcacacttggcaaattggtacgataacagcagaggatgaattgataattgaactatatgaacgagatctatagatgactttactagagagtatcatagtgctaatcatctttatcattattgtcataggatattttacagaagactaaaataaagcccctagaatcgcttctaggggcttttgtttgcattagatagggaaacgtattactaaaataaaaagtgcgttagaatgcgttacaggaggttttaggaatgcataaaatcttcttcagggcaggttgagagataagagatgcacgttgggacaacaacaacattgtctttaaggtttgcaaccaagccttttgtaattccagccactgctccgttaatatctgcttgacggataccaaaaccttgttgtgcggatagataacaaaatccctcacctttctgttgattattattgaagtaataaacgtagtgcatcataaaatggtctttaacgatttgttctgtggtcataatattctcctataagaaaaggggctttcgccccttggtcaagttacttagtcaaatgatcttctatcatttttatgaaagcaggattgctaaaagcctctgctgccttttctctataaacaaagactcctctatcttcgtaaagaagagtttcttcgtaattaattcctgggttaacaacaatcatttttgtacccatattaagtgcagggaataattcccaattaaaattgataacttggtttgaacatcctactacaacaaccaaatcttgcatggtcaaagtatcaaacaagtgagccatatctgcatacaaaggtgcagcctcaccaaaaaatacaacattaggcttcacccagttataatcatctatgtttatactattgtaaccaatgtctaccagtgttttgtaatctccaggatgcatacggtaaactacttcaggaagatatccgtgcacgtgaataacagaatccctgtccacacctgctcgctctagtagatcatcaacgtttgttgtcaagtttactacttggttaggatattccttaaaccactttgctatttgaatatgtgcagcattaggttgtacatctttaagctcaacacgtcttttgttataaaattcgtgtgttttggcatacaagtccataccgttctcgtctacaccaccgaccactggaagatctggagatgttctcacacgataacctgcttggaaagctccaatatcgcagacctcttctaaatcatattcttcccataaggcacgaccactatctgtgtctgttcggaacgttcgaatcccactgtctgcacttaaacctgcgccactaacaaaaattactcttcgcattcaatatcctcttcgtaatcatcatcccaagaagatgcgtcgtaacgctcttcctcttcgaaatcccaattaatttctactccaaagtctaaaaacaatttaacaatgttttctgtagagtagtatttatcataagcgtcagctagttcccaatacttgtcactcaattttttatatttaggatcattatagtcatagacatactttataaccataatcatacatctcttgttcagctttaagcatagcttctggtgtaagaagattagggaacggacgatttctttcttttaacttagaagtaatccagtttgcaacatttgccacttcaccatcttgattatcacctaaacaacttgcataatctccatcttcgtaagtgcctaaatccccacagaccacatgtacaatacttgaatacgatccacacgtttcacaatctgaaaaagtgtctactgttgtaatatcaatagataaaactggtaaagccatagcttctttcacacaagcctcctcatataataacatatcatcaaaacccatatatcctccagacaaataaagcccctgcttggggctttggttaagttttacggattataccagacttttaaggtacttgtcaagggcttcttgatcaccctgacaaacatagcaacggaagtcttgagcagaaggttctttgtcctcgtcccaatcccaataaacagtacctttataacgtgaacctgggaactcgaaatatgctgtatgagtaatatgatgtgggccaccccaaaactgtgtaaaagtaaattgaggatacgctgctttaactgtattttcaaaccaagttttaccgatctatgcttcgtttataaaataagcatggcgttccatttcatcccagtctttccaaacgcatttttcatccagagaaaaaacaaaatcttcactgttgaattcatctgtatcttccaaaatatcataatcatgtgcgctaggtatccaccatccagcttctaatagtgctttcacgggtacaaaacctttttcagcatattgatcaaattcttttactctacgtacagtgcagtattcatcttcaccaccaatgtccagcagacaagcacctttgcgtcttgctgcaagaccatgtgtatcaaaaactacaacactaccttcaccatcttcacgatctacttgatatgcaactttttgagtcatattaccccccaatgtatatgggaaattaaccaaaagataaattcccaaaaacaccaaccaagaaaagttaatggaattataaaagctatcagagcagtcttccagcctttccacaatgtttccactattcctccatacatttaagaatatgtgcaatgacaggtatagtccaaccgttacctaacatcttatatgcttgtgtgttactactcactttaaagtagtcgtctggcacaccttgcaagcggcaacactctttaaccgttaactttctataatgtacgccttcacttaatttttcaaatgcatctagatatcttccaggtggaatgtaagctaatagtacgtctttaggcacagtcgtgaggcaacgagttttttcactgtcctgaacttccaaacaatgtaccaaacgatcagttttagatgtactacgtttgccattttcattaattctacgcccatatattgctgccggataaaaaaccagttgtctgcgactcttttcaaaatactgttctatattaccacctttggcataatttgcatctatgcaataagccttatctctgtctacaatactatcatcttcaatgatatcttgcagcacttcattggtaatctcccaaggttttatttcccagttgcaccagtataaacgttgtctattctgtgccgtgaaatctgcggagttaatgaatacgggatcaacacctaagtaacttgtgatcacgttttcccactccactttcatcttaacgttttcaagcatgaacttaacattagggttaaactttttaatatgttcaagaatttcaacatattcgaagaatagcttagatcgcggatcttgaaagttcaaacccttaccagaagaagagaagccttgacacggactaccacctaacaaaagatcaatttctccccacgggatatcccattctctccattttgtaacatcacctaactgaataatatctggaaaatttgcttggctttcagctacggcaaatttgtctaattctgaagcgtaatatgtatctacttcaatacctgcactttttagcgcaagcattcctcctgacataccatcaaaaagacttaaaactttcattattacttcttctccttaacactagctggtaactctgccttgaggcagaagtttaaacggtaagcctcattctcatttaaaagtacagattcacacgataaccagaacaagagatcctcaataccagggctgtgaagccaacagtgcagaagagaatgttgttctatatcaatgtaatttagcaacaagccttgtaaggcgtaactagttcctgtcgtttttgctttttcaaggatgatattgtgtttactaacaactttctttctaagaccaaaccatttattaacaacaacagtctcttcttgtagttgttttcttattttctcacattctttaactacaatctgcatcttatccactgctgattgaagttgttcttttgttgggtttacaaaataatcactataatacatgctaaactcctcttctgtttttctgtagtttattctaaaaaactggtgttgtcaacaaaaaacccgccgaagcgggtttatattattctacaggaacttcttcaccaagagaaacttctaaacggaatgctttactttcaatacattcactaccttttagaaaatcaaattgcactatagactgacttaatagaatagatagaatcacatcgcaatcttcactaggagctagatgtttgtattcttccttcaaggtaacatcataaaaacataaatcccctactcctagttcatcccatccttcccacgcatctacaaagttaaactctaaacctttcatacaacctcctcgtaattgttattgtgttttactgtctcaacatacaataaagattccatctgtaatacattaccagaaataataaacccataagccatttcagatgtgtctatatcatatgccccgtcttccggtttagcaaagtgtaaaattatttcatctgggttttcttcatcccatattttagaaattttccgcaccagaatattagctaaaatagttgacattcgggataaagctgtatcctcgtatcttttaaaacctaaccaatagaggttaagaatttctacttcttcttgtgttaagtttttgtctaaagtgatcagatctgtaggatacatcgtttctgttgaacctactattacaaaacctggagtgttatgaaaaacaatcttaactttatcacgtatgaagtttaaaccttgtacctcaactatatattgtattgtaggtacaatatcgtttgttacatcaataaagctatctttaatgacacttatattatttctggacaagaccattctcctctaaaataggtttaataaattcgaagatttgttttttacttttacctcgaatattaaaacaaggaacattaaactttttagccaacatccaagctgttcttgtaccacctaaaggatctccattcttatctgtatttgcacaagctaaaagaaaacaagatggttttggattctcaagatctctgccaagaacttggtggatatttctttgatgtaattttttagcaccttgagataatctgtcccaagcgggatgcaattcttttgcatattgcaaagttagagcatagtttacactatcgggtctgtcaagaacaataacctctccctctatctcattacctttaaacgaaggccaaggaatgtatatttctttctttgtattgtttccactatcatataccccgcattcaaatgcggaatctgcaccttctgctttaccagatcgcaaaatgaaccatgtagataaccattttgcaacagctaccatagtgtcccattcttcgtctgtaatgtctctgctaccaacacctgtgtagaataaatcgctcatggttttctccttaacaagtaatattgggaataatattaggagtaacaattggagtaataggatacgtataccaagggcttccaatttcccagggattataaggtgtacgaggatcaaatggaggcgttacttgaggctttttccaaatctccgctagttgtttcttccatttatcccttgctgtctcgttatcttcatccaactgttcgtcattatcttttatttctggttttggaaataaaagctctttgactaactcaacatcttctgtttcaatagtagtttctttcgtaagtttccctactgtctctttaattgtgactttatacattagtcctcctctaaagtagaataaaattgtaacgtatttgaatcatcaaaatatgcaaaggttaaattaccattgaacacagacccagtatccatatataccctattactgctaatcacaggtttaggaacataagaatgcccgtgaaatacataatctactcctgaaactctaggaagaagaatcccttcaagggcgcaatctatcatatcacgatcccacattaaagattctgtgaatcgagatacttgttctttattcatattcgaacaaaatggcaaaacttccgtcactggtagatgttccaaaactgaaggatatcctccgtgaataaagcctagtttcatattacgataattgacaacaagtacaacaggtaagtcttctagcatcaaagcaagagcagttgcaccttcttctccacactcgtttagaactgtatggcctccgttctgaaaccaacattcgtaatatcgtctatcaccttctagcaaccctttaatcatcatatcttcgtggttcccacggataccataacgatttagctttctggtgaattcaacaacacaacgaaaattctgcttgccgcgatctgtaagatctcctaaagatacaacaacatcttgatctcggatacctaaagtattaacacctttctggtacaaatcaaagcaaccatgtaaatcaccaataataaacaggtcttgatcctcttttacactaatttctttatatactagcatcaactctcctcaaaatccataagtataaagatattaactttaccttctatgttatgttctacaacaagatctgcaaattctttgtaggctttttcttctatttgttcaatgtgagacgctacatctttgtatatagcgtcaccatctactttaacaaggaggaatagagatcttacctcaatctctttattttttcggggtagaaaatcgacggcttcttgtatacgccagccgagataccctggagtcctttgaatatcctccaaatgactttctaagatttcccttcctttgtctattaaagcctgttctgtcgttattttcatccccttctccttaatgtgttaatgaaactgcgtaactaaacacaggttcagatattacatcggctacagtaataaaaacgtcttcgtcttgagttgtttctacacgacatacagttacaccattcaccacgaattcaacgcaatgtggaatatcttcacaaacgaaggtagtgtaagtaacacccaaagcatcatacaaagatttaacagtgtttgcaagtgccgcagtttcttctttttctgagacaatgaatgctgtaacaataagattgtttgcatagtttaaactgtcctctatagccaatgatttacaaggtagtaatgcaaaatatttacctggtttaatcagacctgcttcccattgattcaaaattgcctgggatggtttagtaatataaaacagattttcacttgggttatcaatattacttctggcgatacaacgtgaaggattattaatatcaaatacatgatcaaaatctacacaaacaggtaaactgaaaggtgtgaattttttatctaataatcctatggctgataatatgtttgctgtgcttatcttcccgttaaaagctaaacgcatatttaactcctttaactagcaaccgtaacttccgaactttcttctttcgtgctgtctacgatatgcctggtggcaatatacgagacttgccagttaccatctggtgtagtctcaataagtaccctatctacttcgagaaaatgcaaaaattcaaccatcgctcgcttcgataggaattgttttttaacagtctcctcaaaagattgaactgccatgtttcctccttatttaatattcaattttgcacaaagacgttgtaccgctttggcatcgaacaaactcccacgaatagttctctttcctgattcattcagatgctttgcaatcgtcatatatggcgttttacaagctctgtatgcaactaaagaatcttttaaagaaagcgcaaactctcttgagcgttttgcttcttccgttttcgtataatctgttcttttgtatttagggtttgctgcaccaagaagcgttcccttcgcttttgctaccttaaggctcttcttaacacgatcagatattgcacgagcctcttcttctgccagaactgctaaaatatttattatcatattttcagcggagggcatagttgctattcgtacattaatcatctctagtaaggttgcaacagaagctgtgttacgtccaagacggtcaaccttagcaacaacaagtgtagcacctgtttctttgcaaagattaacagcttttacaagctctctacgttgcttccaatcgcctttaccagaataaaactctgcaaagctacctacaatagtataattttcttgtgaatccaggaagcgttgaatatctgcttcctgtgattctataccatactggttgccttgttgtttcttcttagaaagtcgatgatatagtacaaacttcataataccctcctgttctgttacaggaagtatgcactaccttaatgttaaagtcaacagttaagtagtggtaatatcatcctcttgaatactagggtcaacttctgcaaagatagcctctacaggaatttcttcacctgctattctagaaagaagcactgaaccaatagcttttgcgtgttcttcggattccgcataaacattagttcctgtgtcttttttcttagtttcgttaaaatataccagatagtaattgtatgccattattcatcccaatcgccgttacgagcactttcaagaaccttgacaacttctgcatactctacagctaaaccagcacatacttcagcttgttttgcaatagcttgtttaaagaacatagcgattgcaacactctgtgttgtgtgaatgttatctgctttagttgatacatgaagatcaaaatcttcttcatcaaaggtgagttccatagtaacaataaatttctcggtcataaaaatgctcctcttaaacaaaatagaaaggttgagttaaacccagcctgttttttgggtcgtagacgtaccaagcatatgctgtcttatcagtaccacctgcaacaaaagatggtcgttcagaaagaacaatcaaatttgttggtggattctgtttatggaattcccttcgtttaatagactctaggaacccaagacgcaacaagtatatgcaaacgtctgcttcttttaagctcttttgcaagaactcaagtgcaagtttgaatgggggatttgtgattataatatccggcttagtatgccattcgtggttaaaataatctttcccttcttctaactcacaatattctgatccttctggaaaatgttgataaattgcagcagcagcgcctttacacggttctgcaaaaataaaaccttcttctttaaggttattaaaatctattacactaaataatgcatttatacatttttgtggagtaggatagtaatcagttggtggacgatcatacttatttgccactacttaaaatctcctcttttgtgatttcagggtcttcttcaaaaaccataatatctcttaagaacgttaattcttccatagatactggtattgtatcttcttctgtttttcgtttacataaatcgtcaagaaagtttttaaagttttctgacaaatcgtaaaatttcaacagttgataatcacaggaggagatcctatctagttctaacattctttctaagatattttctgtgttgccgtacaacacacgaacttctccgaaagggttgactgaatattgtgaagttctgaaccacccctttttagatacagtgtaacgctgttctgctaaactttcaataaaatttttagctcttttacaattttgttctaaagagtagtaggctttttctacaaaggttacaggtactggtaacatatctcctcctaataacccccttgagggggtttatactagattaattatcagaggacactttatcaagtttttcagagactgtcaatactttttcttgtgattctttcatttcggctaaaatactttcagcttcatcactatcaggatcaccagtcaacagcatactaattaattgctccttgctgaagttcagaatatcttccgctgttagctccagttgttcttcgatctcttcgacaaaagtttcaccaccggaaaaagcatctcgtagttttgcaacttccatcgcttcttctggagttgcccctgcatctaaagctgctaaagcaaaatctgccccactaccaacagcataataatcttcagttaaaggatatgctcgtgttggattattaccctcgtgcatataaattttaccatctggatgaacaaccaatgccacaaactcttcatcttctttgtcaggatctgattggatcaccaaacctgggattgtctcttgtgctgcttgacattgtaagttttgttcgaaccaagaaaagaaagtcaggatagaagacagacgtcctgcaccaccaacaaggtagtccccaattttacgcactttcttgaaatttaaagtgtctacccgactacctactgttactttaccgtcagacagaattttgttacgtgttgcaataattgttgtcattatacttcctcctgtagtgttttaaggactgctttaccaccgcttacatatttacgaaggtaatcaatagctcttagtgtttctttatccacaagaattttattagttcttgttagtggatgatttagtaaatcactgcaatttcttactaacatagatttcttgtgaaagatactgctaagaaaaagaagtttagaatcttcttcatcaatcaggagtaattctgaattagacccagctatatttattatacactcaaacaagccttcttgactatcagataattcctggtaatatttagttagccaatcctcgccttttaaccaactaaaaaacatctgaactttttgcaaagttgtcatgttctctaaacgaagagatatttctttttcaatcttgtcaatataaatctgtctaaactcattcggcttaactaagccagcttgatagcattcatcaataccattgcgatcaatctcaattagcgtcatttaacctccataataggcatccttgccttgtaattattaatatacttccgtgatgaactgagacaaacgggaacgttggttatcagcagttgtcatttcaacataaccaataaaatctacaatagcttccctttctccttcttcgttaataggaacaacacgatctaacaaatcacctaacccgttagctcttcgtttaattgcatatgtttgattaacatcacccataatgacaatacgtgtattaagacctgctcgctcaaggagaagttttactgtatttggtgacataagttgaacttcatcaataagaataatgctgttatcccacgtagcacctagtgcatagtttggaatattaagttcaattttgccacttgcaatatcgttttccaatttatttgcagtcataaactgttggaaaattcttttagttgattcgtagtgtgctgctagtttatcagttttatctccagataagaaaccaatttgatcatcacctacttctgtcgggtttttaaggaaaatcaactttctgaaatcaccagctttaagcatttgcaatgctttccatagtgctgttgtcgtttttcctgttcctgctggggcattaacaatggttaaatcattccaaaccatgcttcttacaatagcttcttgattcccaataggggtaaattcatcaagacggtaatcatcatttcctactgctttagccgcataacgactggcacgtttgtcatcattggctgctgattgacgacgagcctttgcggttttgtttcccatgtttgcactccttataaaaggggctttcgcccctttgtttagttataagcgtctaatgttccagttttaagtacctgaattacacgctctgcgcgattaggcgtttggcgataccatttacttttacgtaaatttatagaggcttgagtataatatgaattactcactaaagtcaagctatttttgaaagattctgcacctttcaaccccatttgaaataccatattaataatagccattttacgattaggacttactttatcgtaaataggagataatatggtacttgaatggatttgttgtatcgctttctttacgtcactctcaaagatttttctagcttccgcttcagtaataactccattggtttttctacctactaagttatcaagaatgcgtatagcttctgctttatctttgcgttttgtcagaaggtgtccaataccaactgtccaatacccttcggtatcaggatatacagttagctttagtccttcatcaaaacgtaacatatcaaacacatcaactactttagccatgttttccttatatcagtcgccctccccatgatctagctcttgaaacagtaggtgttcaggagacatttcacgtttaggcttcgtctttttagtttgggacttaagctctgttgccaaagcacgagaaaagatcttacgtttctgtttacctttcatattgttactccgcaatctgagccatgaattcacgtagttcagaaaaacctcctacgtgggttagctgttcaccatcttccacaaaaatctgaggaaatgtgcgtggtagaacgcctgttttctctaaaaccagattctgaatctgatctaaagaatagtcttcatctaaggtaaggtatttaaaatcctgttcacgctgttctagtagaatcttagcgttagtgcagaaaggacaatttggtttaccgtagataataaaattcattttcactccttgtttaaaagtatagttaaagttcttacaataccgctatcaacacttcgcggatttaaagtagaatctgtttttaaataagatgttgctggtctgactgctttggaattataggttgaagcagacacaggaattaactgtaacagataaatctataacaagaaatatcttacgtgcaaaatcataccaagaaatataatctgcacctgcatagtgtacaattttactatttacaccatcttttacaagtttaaaaattgtttctgcaagatcaggtgcataagtaggacatgataaatgatcacatactacattaaattctttttgaccaccattatagcgttccaacattgttttcaaaaagttatgtccaaattcactataaacagaagctgttctgataataagtgctgtaggacaaactgtttgtactaaagtttcacctaattgtttactgtaaccgtaagcattcaaagggtttgttttactatcctctgtgccagcaacagtaccgtcaaaaacatagtctgttgaaatatgtacaaactgtatcagtaaatcattacatgctttagcaatgtttgttgcaccatatgcattaacattcatacaggtgttaacatcttcttcagctttatctactgccgtgtaagccgcacaattcacaacaacatcaggcacatgctgtacaagactattcataacttctttaaagttggtaatgctgtctcttcttgcttcaatcaaaacaacatcttctggtgcaacttttgccaaagattgtcctaattgaccttttgaaccaaagattaaaaattttgtcaaaatatgatctcctttagtgttttggcttcctgatctttttgtgacaagataggtttaaaattaatatcattaaagatagtaaatcaaaccccaatctatattgatatctggatcattccacgcaagactacactctgaagtcggatcataatattctgtacacttatattcaaaatcagcaatatcgctaatcacaacaaagccatgagcgaaaccaggaggaatccaaaattgtgttttattcttttcagataagagaatacctacccattctccaaatgttggactaccaactctaatatctacagcaacatcataaacttcaccacgaacacaacgtactaacttcccttgtgggtttttcttttgaaaatgaagcccacgtagaactcctcggatagaacgtgaatggttatcttggacaaagttttgtttacctatgtattgatcatataaagcctgattaaaactttctaagaaaaaaccacgttcatctccgtaaacgtcaggttgaatgatcaacaaatcttcaatttttgttgcttgaatcatttaatctcccctttattttaatttaagtaaatacttgccgtagtctgttttacttaaaacctctccagaactttttacagaatctaaagtaatccattcatttttaaaagcaatctcttctaggcatgcaaccttcataccttgttgcttttctattgcatgaacaaactgagatgcttccataagactttcatgtgttcctgtatccagccaagtgaaacctcttcctagcttacaaacacgtaaagccttttctttccagtacatctcatttatatctgtgatctctaactcccctctagcagaaggcttaacgcttttagctttctgtataacagaattatcgtaaaagtacaagcctgtaattgcatagttgctttttggtgcttttggtttttcttcaatacttaccactgtaccttcagaatcaaactcaacaacaccaaatctttcaggatcatttacgtgatacccaaaaatattagctccaccattcttttcaatatgttctctagcagaatctaaaatgctaccaaaactctgaccaaagaataaattatcacctagaacaagtgctacagaatcttcaccaataaagctctcaccaataataaatgcttctgctaaaccttttgggctgtcctgtattgcatactgtagggaaataccgaaagaagaaccatcacctagaagatttacaaaattaatttgatcttctggtgttgtaattattagtatttccctaattccagaaagcattaggacagagagtggataataaatcataggtttatcgtaaattggtaatagttgtttactaacccctttagtaactgggtaaagtcttgttccactaccacctgctaagataatacctttcatactcctccttaaactttattttcccaccactctttgttatctacataccaatcaatggttgaataaagtttttcttcaaatgtgcctttagctttccaccctaattccttttcaatcttataaggattcacttcatatcttaaatcatgcccaggcctatctgtaaccatctcaatgaggctacaagcatctgtttcagatggatataccgcatccatataatcacaaatcatatagattacatcaatattagttctagggtttctgctcccaatattatatgtctctccagatttgcctttagttactaccaggtgtaatgcttctgcgtgatcgtcaacgtatagccaatctcttacttgaagaccattgccataaacagggattggtttattcattaagatatttgttatcgtcttaggtattagtttttctggatgatgatatgctccaaaattatttgaacaatttgttataactgtcggaataccataagtacgatgccacgctcttaccaaatgatcgcttgcagctttagatgcagcatatggactacttggtttataaggattctgttctgtaaacggataatccccttcttccatatcaccatacacttcatctgttgaaatatgatggaacattttaagatttgatttatctcccattaaacgaacagcttctagaagattaaatgtcccaacaatatttgaatttataaaaacactcggtgatgctattgaattatctacgtgactttctgctgcaagatgcattatataatctgggttaacatctgccacaatcttagcagttaactgagcatttgtcaagtcaacacgacaaaactttacattaggtgtttctgataaatttctagggtctgaagcgtaaccccatttatctataacgtaaatatcattcttagtatttttagccaggaaacgaactactgcacttccaataaaacctaaaccacctgttactaagtatttcatttagtctccttccaattattcccttcagtaaaaataataccttcataaaacaaccatctggaacctttttcaacaggaacaggaatctcttcttcagtaaagttataaacctctctagcatcttctaaaagtgatgcaaatgtttttggacttactgttacgcgaggagcattgatcagttgatctagcatcattctactatcctccttaccaaacgtgttgagaaataatagtttccgtttcaatgttatatttttcaagaagttgtgcataggcttcttttgcattcttatttagttgctcaagatctacagctacacttccttcgccaccttctaaataaatcccatatatgcaataagatgcatcagcgtcatagaaaggtgagatacgacttaaatcaagaccttcttgtaagaaccagttaaaatctccatcaaattcttcttcaattctaggatcttctcctacagcctcttcccatttattaaaaggtgcaccctgtaacatacgccattcagtggcaactcccattatcttcctcctcttctttttcttccgtgtgaacgaagcctaaaccgttacaattccaacacggaataaattgttccatactaacaataaaattcccagtgccgccgcagataggacaaatacttacatcatccattattaaagctcctcaatcttttctaacatctgttttaactcattctctgttaacagaatttctgtgataccatcataagtttctaccatcagagtaaaacatttttctccatctgaacacacaaaagcaccaccttcatcttctgttaagtcagaattaatatccacatcaacaaaatcaatcatctttttctcctttgataatttcaaacttggctacaccattaactataatgtgaccgcaagacataactcctagccaatgatcaccattcttttttaaacgtttaccgtaaacatcacagaaaccattctgtaattcggaagcctcataagaggctcccttttcgaaaacgtctttgaagtcagaaattaatccaacacaaagtagtttcattaaaagtctaactcctcgtcatcacttacatctttatttgctgaattcagtttgtaagctgtaatttggatctcctgtgctgctgcttggatttgatctggatttaaccaaacatccatccaaggcagtggacttttcttcggtgcacggaatttgtgtttcattttcagtctgcgatagataggagcagcattgaagtaaacccaaagtttgaacaactctgcgttaccaccaacgataatccttccttcactaaacagatagtcacaccaatcttcctcttgtccaactaccgtgtcaagaatttctgtcagaacgtcgatattatcttcgtatacttttctccagacaggatctttcagcagtgcatcaataatagcataatccattttaacgtgcaatagttcatccaacataattttttgaatgagtttagctgcacctacaaacagttgctgctctgctaaggcaaatgttgcagcaaaagaggatatgaattgaatgccttccagaccgataagtgcaatcattcctttcagaatcagtagacgaaggttatcatccttctcaatcagacctagagcatatttatgccctgcctctgccagatcactcattatctcttcaactatacccatcctctggaagattctttcgttctccataatctgatcgataacttcatttggattagggatacactgacgaataatttcagaatatgtcaaagcgtgtaaaacttccatttctgattgcttcatcatcattgcacatgcttcgttgttgcttaaaaatggtgcaaacaaagtgatgattgatttagcaagtgaatcattttcccattggaaagataggtttttgatcataacatcatagttgcttttagaacaagctacgaaatcttttcgtgtctgatctaagtttacttcgttttcatcccagtcttgctgtttttgtagtttgtacagacgatgcatttctgggtatgttacattaatagaatcaaaaatacctaactgttctcccaaaaacacagggtagaaaccttctttgtaagtgtcgttgtataagttaattgctgccatttaaatcctccacaatatcgcacattgcttttattgtatcaatgtgttctctctccataccatcctctaggtaagccttctctaatgcgtcccatacactctttgtgagtagtatagtaacctctccctcataccttgctctggttaaagcataccaggtagctatgggatcattggaagcccatatttcaacactggaaaattgaaaacctgcaatataatgacaacaccaatcgaatgtaaaatctttactatctaccagtgtataatttccccagcgtctttgtggtgttgctccaggtaatacaactaatgtaggcatattcctccttaagaaagggggacaaagccccctagtttcattacatcttacaagcctcacaaccggattcttcatcctcttgagcgagggaggttgccgattttgttctgctatttagataatacaaagatttaccaccaagttttgcaaactgaaggatatattgcatttctgatttaatggataaacgaccaccttccatcttagaatagtcaatccacttatcacatgatgcaccttgatctaagaatttagtcaatagtccatatgcttcagccatatctttatctggcgtatcccaagccgattggtaaatatcttttagtttatcgtaatctggcacaataaacaggacattacctttttggctttgtttataaactatagtatcacgtacaggatacacagagttagtcgtattacttacaagactactggactcatttggagcaatagctgctaatacgctatttcggataccaccttgtgcaatgatatcttgtcgtaaaccttcccaatccattttaagtttaaaattgccaatatcgtctacagctttagcgtaggtatcaataggcaaccatccttcaggccatttggttttatgcatccattctgcattacctttctcttttgccaaacgaagagaagctcttgctaaccaataataatgtctttctgctaattcgtgaattagttttttgccgtaaggatctgaataagtaacaaaattacttgctagataatgtgcaaggtttgtaatacctacaccgatagacctacgtgctttagcagtgatttcgttatgtttaaacggatactgcattgtttcaataacattatcaatagtcagaacggtataatatgcaacatcttcatattcttctggtgtaacacgaccagctacaatagaagacaggaagcataatgccaattcttgatcttctgtattctcacctgtgaaaagatcagtcatattgtgaaatgctttcgtaggtaagaaaatttcttggcacaagtttgactggtaaataacatccttaaacggagtatgtttattaacattatcagcaaagaacatataaatacgtcctgtctctgctctttgtgtaataatttctgccagaagatctcgtgcttttacaaacttcttcttaattcgtttgcgactaactttttcatatacttcttcaaactcttcctcgcttttataaagcgcctcatagagttctggtgcttcgtcataactgactagcatccaatctttaccttttgctgcacgacgcaggaaagcattgtttactacgatagagtaatcaagtttatctactcgtttttcactaaccgtagttgggtttttcaaacgtaccagatcttcaaaatcaggctctaatattgtgaacgttactgttgcacttccaccacgacttgcttgttttgatgctccaacacttgtttccatccacttcagatatggtaaaagaccaccgtgaacgatacggttgttcttaacaccttgtcctgtagcacgggtttggagattaacaccaatacctgcattattcaatgtatattcatgcgcaagatagttagcaattgctaaagattctgctgtatcatctgctctaaacagacaacaagaagcactacctttaatcttagtacgcaaagttgttaaataaggcgatggtaaattaatcttaagatcacttacgtaggtatatagacgtttaatgtcttctactctgcgatcttttggttgaatttccattaccttcattgctacaccaatgaataaaaactgtggtgattcaaaaacaacatcattgatcgcatctttcacaagatacttatcaaccatctggcgcagtacggaataaccataagttaggtttttatcgtgattgacaattttaccaatctcaataatttcttcttctgtataatccatttttccccaatagcctttacttacagacatattgtagaaatccaggagggaggggatatcatgatatcccccatgagcctgtttataaatcataccaagaagtaaccgacctgccatatcactatatgcctgatctttcttatcaatacatgctgctatcatagctttatgtaaatcacgagtaggcacaccgtcgtaacaacgtttaacagcttcgagttcaatttcagaccaatttaatttaccagcagcaaactctgaccatttacgaagtttttctggattaaattcttctttcttgccgtttgtttttgttacataacggatagatttgcttagatactgagtcacttcctctcctattaattgtgcatgtttagaacatctacatcataaccgccacgcatctcattatataagccatttgcgtatagaaaaccttcaaaatgatctataccttcaaaaccttttgcctttgctttgcggtctgcttcttgtctttttggggataatcttttagatgtatcaaggataactgttacattgcaacctaatgtttcatcaaaatagacttcaatttcacagccttcatatttattactttctgtcatttggcctctcaattagaattcagaatcatcatctcgtgatggatcatgttcatttccgaagtcttccattttgatatgagagctaccccaacctgtaaaatcttcttctccaaagtgcaaaatatctacaccttgatagattcgtttatatttatagtcctgtcgaactgggaaagtatacaatgtagtatttgcaaacaccacacgtcgattgttgttactacgaatattaacaccacgttctactgtataatgtccatcggtagacataccaagcattactaatgctgctcgcaatgtagtgttatgatattcgtgaggaatttttcctccgtgttttttagccatttctttccagatcggtgtagccttaatggtagacatacttacggtcgcccaaatggttgtattaattagtgacataaattctccttctctcttttaaggagagcatagctctcctaacgttagcctatactacacgaatctcaattaaaagtcaactataattttaagttgatcaccattttgtatggttagtcaaaagttgacgatgttgaatccaaccgcagaagtttccactccacaaacgatgtttacgatccatatgtgtaataccttcttcccaagaagtagggaacggaggaatattaataccacctttctgttgttttaatcctgacaaatccatttctttcattggcgttgcctggtgttcaaacggagatgcatgtaccttttgtccagacagcaaacgagaatagatatccaatgctttatctttagtatcattcaacttacgataacttacctgagcgcaacaagaagctgaaatagcttttgcttcatcttctgtcaacattttctcgttggagaaggtttcacccaagaaataacggatcataccagtttctggatctcgatcacgattaacgtaaggtgtatgccattcccctggaaaaagaagatatggttcagaagattcatacagttttttaatttctttagcaagagcctcgatagtaggatctgcatcagcatctacgcgcaaccacaagaagttttctaactctgtagtggttactacagtcttcatacgctggaatggttctagtagtcggtttgcaacctgtttatgataaccagcaagggcaaactcttctgcaaaacgtgcagcacttagtgcagccaagtcccaccattcttttgcagtgtaacctgcatcaatcagggcatcgtgatctgtgcctttatcttgcatacctggttggttagcaccaaaacgataaggacgtgctggagattgccgtaccatttcaattagagttttaacagggatagctcgacttgatgcagcattacgagaaaacaaacgatgcgtcatcaattcagagtgaatgattctaggatattcaagttcaaaggtaacaatatccttaccttcagatgtttgagagtgtgcaataatttttgctgaaatagaatctgtcattatttctccttaaggtagtaaaatactttcaatttcttcccactgattatctaaaccagtgataattacattaggaagtttctttaactcttccaagtatggatcttcgtaaatagtgttgaaatatattttcaacgtttcatctggaaataggacaagattttcagccctatcatcaatagttacgtcgcaaggtaataagtatttttcttttgttgcgaaaaaaccattaccagatgttctactaaaatccactttatctaaagatcgtattacgtgtctatatttagaactaaggtgtccacccttagtgtggcttgctatagatatattagctccatttgcaattatacgatgaacaacatctgtactattaggtactactcccatagtatcatatagatgttggttatcccaaaaagagtaaggatctacaccaaattgctttttaaaatcagggaaatatttcgtaatatcataatgcacagttttatgtgtcttatcaaatttgatattagatctacttaccgcatttaaccaatttaaccattctatatccgcaggagctattactaaatcccaatcacatactagacgcattatttctcctgttataacattttctacacattgtttcgtaaatgtcttctcccccaataacaatctgttctttagagtcgataagtctagcattgaaaatagcttttcttccacatttacaaatgcttttcaattctgtaattgaatctgctatggctaataaccgttcagaaccttcaaacaattctgtagcaaaatctgttttaagtccatagcagaatacaggaatatcgtaattatctaccacatctccaagaatgtcaaccatatctttagttaggaattgtgattcgtccacaaatactgcatctactggattttctttaagctgtgtataaatttccagcatatcttcttttgttttaactggttttgcttcctctttaatacctatcctagaagcaatagcacaaccagatctggtatctaaagccgaagttaaaagaagaactttcatatttctttctttatagttccaagctgtttgtagcagatgtgtgcttttaccactgttcattggactatatcggaaataaagtttagccatattttctcctctaacgctcccatttgtgggagcgataatactttattatttctcttcgtcaagaagaatttttactatttgttttcttcgcttagttattgtactttctggtgaaattccgcgcttcgttagccaatttttatcctttttagactggcataaagctatcgcttccttctccgcttttgcttccctgaatgtcatatcgtgcttgtcagcataagccaggatagcgttacactgcttacaaactacacgcaggtcgtcttctgttacatacaataggcgtaaaacaaaacttgggatatcttcataacaggttaatgtacctgctgcattaatatggtctacttgaaagtctttcatacctcctgtatgtccacacaattcacatttacaattccaaacctgtttcggtttgcctgttttcttatctaaaactacattgccatctttatccaacctatcagctttaaatcgtacagattggatcttttttattttattcgggtgtctcacccatgctttccttaagcaaccccttaaatatgtataaaaggctgcttgagttttccaaggtgttccatctccccaaataactttaggttctttattttccaatagtgctcacctttttagctacataatctccaggtggaatgttatacttaaagaaaagcatacggtctaaaccagccttacacatgttttctgggattgtgattgtatataggagtttatctccacgtttattgtatattttatatacttcaccctctccgtattgtttaccgtgagaagccatctacactctccttcaattgttcaatagcatctgctgcttcaatgtacttacctttatacattgcttttaaagccttacgaacaagatcatcgtctgtgtataaatcaattagctgattagctaactcaatttttacagggttttttagattagggtaggcttcatacaacatattgtaatacttatcactcaattctttttcaatatgaataacgtgaatcgctttgtttaggttgatcacacgatcacctttgtttcgacaagcatacttagctaacttagtgaaacaaggagttgcaccaattagatatgcaagttccaaaggttgcatacgcatacgtttgtagtgatcaccatcaatttgaatatccagtgctgtagtcataaatcctccaaaaataaaggggctttcgcccctttttattaaattccaataacagtgtttacacgcttctctttgctacgcaaattaacacgtccacgagacaggctattacatgatgtgcatcttagcacttggaatgtactaaccgctgttgtgtaaaccttaccaggaacaacttcaaggtgctctttaccgcaacgaggacaacgaagtttttcatcgtcatagaatgcagatacgttaggatgttgtggaatccacgcacgaagtttgatgtaaagatctctaagagaaacaacatcaccatcgttgtaggtttgcatacggaagaaggcgtgtctgtctccttcacaacatgctttccacagaggaaaaccttcattatcaagtttaaagttttctgtatcaaaatacaaacacatttctttaagcgcattagaaggtagtgcaaactgcttcttagctgccttgagtgtatcaattacaacatagtgtgatggtggctccataccgtgaaaagcaaaacgttggttaatataagccttatcaaacttaataccattgtgtgcgatcacaatatctgcatcgtcaagcaagtgccacagatcttgacataattcccaatcatctgtatgatctatgtcaaacagagggtaattgctaaggttcttaccttctacttctcctgtttctaaatcagcagatgaataggaaagcaagtaacctcgacgaataacttgttcaggtgcaataaaggctttgaaacgtgagaagctatacacaatctccggtgctgtctctacgtcaataattttaattactggcccacctttatcttgcggagcaccgcgatgtggtgaatttacacgagctaagtaatcatttactgtgctcttcttagtagaacttcccaacacctcttgtgcaatcttacgcgaagaataaccttgtgctttcatagatacaatcaaggctttctgttcgtctgttaatttactcaatgttcctcctgctctgaaatatatgcttgtagcatactttcaaaagttgtttcatcattcgcccaacgtttcatatataccaactgaaaaattgtctctatccattcgtcagttgtcatctctacttcttcaccatcccaagaagtaaatttaacgccatctgggaaccattcataatactgatctttaactgtctgaaaaagttcagcttgtgttttacatttggaaataagattaaagcaagtaatatctccaaacttaacatcgaaatcttggtaaggtcgaatactatctgtcttatcgcccattagcatttgataagctaaccagtaactaccccagcccttaatttcttttttcttacctttttctacgatccagatatcgccgatagattcatcaatcagaataatacaaggatttttataaacaccatcctctttataaaagttaaagagtaaacttggtgtatgcaagctatctttgtcgatagatgctacaatatgagaaaacttaccagtttccttgtaggctttataccctgcatatccatagatttctaaagcatcatctgcctcaataccagtaacaacgtcaccgttatgtttttcaactagataatctttagtatctgataaatggattggtcttaaatctgatcgttctgatttatattcttttggcattttgaaagaatgccggaaggtttttcctaccccgatgacaccgcaatacttttgaagttttaggtgatccatcatctgggttatttttgtctttgcagcttgaaacgtaaaagaaatattatctgggactatttgaacatcttttatttcaaaatcttctctagagaacaacttcttaccagcagcttcgcgttgcgcgttaagtgctcctagccatcctccaatattttttgaagacttaccccaaaaatctgttcttgtttcaaactcttttacattaccggaagccttgtgtacagcgtggatttttctttgttctaaagccgaagacgcttggaacgccacttgatcgtagtctattgcaagaattgtgttctcgtcaacatatttgtgcaggtcttccggttggattaaaatgtaaccgctaatattacctcctattcatcatctgaactctctgttgagaatgttcgtgtgtagggacactgacgacttgcagaaacctctataaccttgtcgtacataccgttagagtaaaaacagtattttgtacttccagaaacttgttctccagaattaattaaagttatttgaccagcataagaataagaactgattactaaaagtaaaccgacaagaagttttttcatggtgtgtctccttaaaagcccacctaactgagtaggtaggcatattaacacatattaaattagtaagtcaagtattatttttgaatagttgacttgataaggtcttgcataataccacggatttcattaaagcacagaaggacagatgcttcaaaagatccttcttcatcattaaagtatttagggaatttaataccactcaacttaaattctttatcaacaataaagttaacgaagccgtcatattccagaccaatggcaacaacgtgcttaccatcttccataagttctactgcacgagattcataaagggactctttactccatacaaccacaccttcagaatcttcaagtttaatataattacccagggtcagtcgttcagcctcatgttcttctaagatggtatcaaaacctttaataatggcttcttcgtgtacactaaacggcagaactgggaaagtacccaacacctcacgaagaaatacagcaatatcttcactaattttcttagaaccattaagaacataggtaatactgttttccgtgtctacaacaacatagttatagaagtcatctgcctctgtttctggaagcagagaaaacacgatatcagcctcaattgcttttttactttctttgtccaagaaaaactctttagtaggatttgcagcaataaactcttgttccatctcctggagtttttcattaagaatgcgtttaactttcttcttgttaactttcttaacagactgccctactttaataacctctaaaccagagaacacttttacataggaaccatcatcttcaaaacgaacaagaccaatggtatgtgcttgttgcccctgtgccacaacaaaatccagcggtttgtctgttactgtgttcagtgctgaaatagacagaccatcaccagaaatcagggttacgcaagatttgaaatttttagcaaacatagttttctcctcaaataacaactacaaaatattttacaccatcatattcgacaatatgatcaggatatttaaatcctttataagatttaccaaacagactaacagcctcattagctttgttttgcggattactcaaccactgttcttctgtgtaaaacttaaattctgttctcttaccttctttttctaaaccaacaatttcctgtgtgatatcttcaatacctgcattcttcaaggatttgattacctgacgcaaaccgtgtttaaagatatcttctgctgttaacataatacctccaataagcccccgaaggggctttatttcttaagcaatgattgctgcgatattaggtttaacaaaggtagatggtttcataattttacctttgtcatcaaagaatacatacaccttttgaacttcgttatatacagcgtgtaccccagtataagaaccttctgcacgatctttgcttcgcatctcgatagcatcacattctttttcaagagcttcaataatatccttagtttcccaaatagccaggagttgcttcttggtaggatacttggactcattgctattcaacacttcacgcataaccttcttctcgttataaacagaacgcaccaaagtatctcgtgccatacgtgtaagtgtaagagacattagggcaaattgcaaatcattttctaccattttatcaaattcaatgataacatcgtagatgttttctgccagaacatctcctgtcggcatttccagagctttatcaacaccttctttaccaaagaacataaatgccaggtaggatgctaccacaaaaatatctgctgctgcatcaagtaattcaacgtgatcattttcttgtgctgctgcttggaactctttaagttcttctcgtacaaaagaaagttgagcttcaaacatctcttgagtaaattctggagttactccaccacgtgccttagcattccaagcaacaatttgatcggcagctttgataaagaagctattgtccacttttacttgtttgaaaaaattctcgatcattgtttctccttatttaaaatattgttctaacaaaacactaatgcgaactaccgattcgccaatatatgccccagcacagaggaaaacaacaaatctacaaaaattgcagtaccatttgtccactggaaacgaggctaacattataattgcaatagcaattaacatcataagaactgttgctaataccatacctacctcttactctgctggttcccaagtacctggaatcatcttacgtacacgtaccccaacaggtttagtaggaataccttcgtctgaaaattcttcgtactcaatttcaacaaattgaccaataagtgtcaaagcattttcttctttacgatagttaatggtttcatctgaatccttacgcatcaggaattcgactactttaccattttccatctcgcctgtcaataccccgtcaccatttttatcacgttttgcactgactaccttctcttcaagagtctgccgtggttccgtttattatacacaataagaacgtttatcaaactcgtaaacaccttgtgcgttacgatacaccacaccttccgctttttcacgtagagcttttgcatagaattcatcaaactgctcttggttttcaatgtattctgtatgcactacacaaatgagttcatctaaacctttatcttcaacaacttcttttagagcagccaaaacttcaaccctcttctcaaatggtacagatggcacaggaacatcatatacatagtatttaagaagcggagtgttagcattatgctttttccacgcactatttaattttttgaaggctaaggaaccccaaaccgcaaaaacttcaccgtcaagaggatgaccaactacttctttaatgaaaggttggaatttttttccgtgaggtggaagtttatatacctccccagctttagataaacattcaccttgcatgttaatcattgaacgtagaccattcaatttatattgtgcatagcctgggaacaaaacacgatcagcataatctttataatcctgacatttcatgggtgtgggaaggaaatggttttcagcttcctcttttgttttataatacccattcttaagttgctttgtccatttggcaagagcttctatttcagcttgttcttctgctgttgtttcatttgagcgaccaatatttttaggttctgctgtataagatttgctagtaatctttccacctaattgaccatgagcaacagttacaacactaccttcggtatagactgaccactgtttaattttacctgtagaagttttaccatataatgtaggattagtttgtttcatctttaacctccagttgcgaaagaacccatttagccatttcaatttcaccatgtagtctgcctagttcataggcatcatcaatattaccaccagtgtaatcatccaccataaagtaaggatcttcgctactgttaggtgcgtttgcaattctcgttagttcttcaataaatgtcatagttaccccttaccaatttacacaagagtttgaatctcttccatcaagtcttcaagatctgtatcaacgtattcagaagatgttgccataaagtatgtaatcattgtgaaacccttccgaaaaaagggatcaaggatatcattaaacatatcttccatttcagtattctcaccaaatgagaataacatttgttgatcttcgcttacacctttaacatagatagctgtgctcatatatttaatccttaaacgttcatttaaatctgcaataacatcacataaatcttcacattccagtgttaaatctgaaacttgtgcactcaaaaaaaaaacttcttcatttagatctgaaataatgttttctaatgaatctacttgttcatcatatgaacgttttgtttcttcaagatcttccctaagagaataaatcaaatgtagcaaagataagagatatccgtctcctgtgtcgttcctccactcacttccgtagcgataaataataatttcaccataatcgactactgtaaaatacttacctttaccagaataaatttccatatactctccttattgtagcttaagtgaactgcgaagacgtttctcttgctgatcacgaatatgttgtggaacctcatgaattgagtcgttaccgtgcctattttctacaactaaagagataacttgataaccaaactcttctgcaagagtgaaaaaaaggtttaagtttttttctgtggtggaggtgttagagacaataatctttttaaaaaaaaaaaccatataatttcgaacacttttctgacaccatatgtgtgctttatataaattctctcggttccactcttatacaccacattctgtgtattgttattgatctgcctcacacataggccaataaaattcagagataatttctgctactgtagatttacctgcacctgaaacaccacgtaaaatgataagttgtttcatttatcccccaaagaagttttctatttctttacgtctctcttgtggatctagagcagcccattgagccttcgtaaaattatttcgaagccattctagcaaagtataatattcttcgtcaacaatttgtttagcgttttttgggttgtcccaaatcatatcccacttcttattgccaccacgcataaaggaatttttagcaagatagtatggtgacttaatctttaagagtaagttaaacggatagtttgtttcacgaacaacaaagccttcgtgtctacaatgtttagacatttcaacaacatctgaaaatttaatcatcggataaacttcaggacgtttaaactttgtaacagatgcaatcccatcaagaacaccttcaggtaacatgaaacttgtcccatcaagattttgaattcttgctcccaattaatatgcgcctggttcttcttcgacaatatgtggatcagaaggatcacagatttcaaaaaggaaagttgcttttgcactttctgtccacttaatgaaatactctatgtcgtcacactcggaaacaatacgattctttgccataattgcaaaatctgattctaggctccctgttgttgatacaacaagtttccctttgtacacacctacagatgccataaaaccgtttactttacggacagcatctacaagttcatctgctggaagatctgtaccattctcaaaacgattaaagattttagtaaaaaggccaaaaacaacattgtcttctgagtcaacaaaccaaccccgacaatctagaagtcgtttgtcaacgttccacaaattgtcccagaatacattgtttttgtatttaagtacagcaagaccagcatactctccagatttaacttcttttttatgcactaaaccttttgcaatcaggtcatcacagttgaacttagccaccttaatctcctttgattatcttatgatgatctacaacaacaatatcacgcttatccataatagagatgatttcgtcaaaatgcaagatttttccgtgtgcgtccccaaccaaatccaacattttcccatacaaatgatcagggaatgatccgtgagagtgcccgtgtagcatgattgatccatgaccttgtttattccaggcagccatagggtaatgacttaagacgaagaacagtttctgatatttcacttcgtcataatataccacttcaccatactctgcaagcacttttctgtgcttactgtaatcatgggttcccaaacagtaagtaatatccccttggagacgggaagcaatcttacgggtatcttcttcagtcccgaaacagaagtccccaagatggtacatttttactcctggtgttgtggcacatttgttccatgcttcgatcagtgcttctgtcatatgctccatatcttcccacgggcgatattcaggagcaaactctcgaatacgtttgtgcataaaatgcaaatcacttgtaataaacattagtataatccctcgctgaatagttcactgtcgtgaccatttctttcatagtttaatttttttgggttatctgcaatgatataagcatctttgcgactccaccaattataatactgatcaataaacccttgattatcaggtaagcaaaacagtttatcgatcaatcctgcatcttttaaaacattaagttgtgcagatagtacaggatttgcatgcctaacacaaaggaaaaattaatcttcgccattgttgagaatatacttattcgcagcgcacactataacacgttgagcatagtgatcctcaccaatccacgtaagaggttggtaacaaatatcatgttgattagtagcgcacatcaattttctccctactcttttaatttatatgcgcaaaaacccttttcacaaaatttaagagcctttttcaaatcgcgacagatttttttctttttatatataaaacacccttcatccccttcttgctctctccaaaaagagtaaagcataaaacctccttaatagttaacacgtttaatttcaacaccataggatgtaataaaaattttccttgctaacatatatttaccagcagcagaagggtttgatgtatgtaaatagatagttttaagagcatcccattcacccgcgtacaacatacattctacatctaagaaagcatgatatccttcttgatcttctccaagatcattatcgaagtgtatatctgagatattattgaaattatcttcatctgaaacaaaagataaccaatccccaaaagatttttaaccaaaagcatcctcataaccataatctttaggatctcttaaatcgtctaaaccaaaaaattttgccactatcaaacccccttccgtttctcttctttccaagttttaccattgtctaccaacttcttagaaacagcaaatctttctccattgatataaaacaaataaagaataaaggattttcctatagttacagtatctgctacttctacacgctttacaccttgcatgtatttggctttacctgaataaataaggaacattacttattccttttgttgttgatcacatctaaagctgtgtaaggtttgtttgtaccgctgtattcaagaataattggtacatattcatagaccaactcaaaagtaccatacacagaatctgcaactgaaataagcatttcagtgccttcgtcgttcttgattaatgaaaatcttgcacctggtttattgagcacttcatatttcttacctgctgtcagcaaacctgaataccactcattttgcacaacagacaaacacttcagataagtttttctcatttctttttgctccttcttttaggcttctcgtataaacctaacacagccgactcttttgcacaaataggaactgacttcattcctcgttttttagcttcgggtagattcaaaacccaccagcccaaaccaaacaattcatcttctgtgaaaggatctgccataggatctgcatcacgttcttcaaatttagcaagagcttcttctatcttttctattggagtatcaaagacaaaagcctctgtgtcaaatttttgtttcttaggagcggcttttgccgccccgtctttagatgcgtgctttgttacggatcgcttcttcggtgttttcgccatcaacaacctccatgcggtgtaagaaatcttgctggaatcgccaatactgttgaccagtccttacatcttcgtagatcacaacaggatcaaatactttagatacacctgctgggtttaggaaagccaatacacgatataaaccgcctttgctaatacaagaatatgttacatcagttaaaatttcttttttcatttcttaataaactccaatacaggtacgtgatcagcagttaaagttacacaattgtaactcaccttttcaacttcagagaatgcttcaacccacagcaagaaattctctttagcttcttcataattcaatgttgacttaacaacatggaactcaccaaggatgactctatagattgtttgcatagtttgattcatttattttttcctttttttaaaagtgttaaacaatcgcaaatgcttgtgacgcactttgtgattccactaattaatgtcagcactatgattgttgagagtataggatactccatcgcccaagtcaacatgaatctcaactcctaactgtctttctaatggtaaacgttttgagaattgataattacaaagtttacagtctaagtcaagcaactcatgtttgcttaaacctgcaacgataactttgcttcccactgtccactcaataccttcaaagttatctcttcttttcaaaatgtcaagtaagaagatgatttgttgccattccgtagacaagtcttcttcatagaaggcagaacaaaaagttttatcatcgtagaaagcatacattatgcctccatctattgtttcacttctaacgtaacgtgtgaccctcattattccctcctgtatggctctgtaacgagctaatagcctctaagatatgcaatcaccttacctcacagtaaaactcgttacaatcgtttttaggaggtttaggttgtacttaaaaataatctaaaaaggtgttgacaaacgcaaaaaagtatgctaccctaacccccgaaaaacgccgagcgcagcgagggggtgttatctaatcttgtgatacatgatctaacagacaactgagtagtctacatatagcactatgttatgtctataatactaacatacatactctatactaacaatagattctttatttaattttttttttaattaaaaataaatatctattgactttagatctatctgtaggtagagtagagaacataaagtcctaactcaactaaggagataaagaatgaaagttagtattctacatggtgttgactgttatgttactgatgtagacgttaaagtgtttacattctctggtggagaacaacatgttcaattagatacgaacctgtcaggtttcaatcatgctacagacagaatcttactcacattagaagtaagatctgctaaagacttgatgactttggttatgactaagaatgcattggacaatatgctatatcataaaccatattgtgttgatttactcatgttgtatgtaccgtatgcacgacaagacagagtgtgtgagcctggggaagcatttggagttaaagcatttgcttctataattaactcattaaatttctcacgtgttatcgttgctgatccacacagtgatgttactccagcagtgtttgacagactctgtgtaatacctcaagaagagattgcttacgaaactttaaaatggaagttacgtatggagaattttgctcttgttagtcctgatggtggtgctcttaagaaaatatttaaattatctaagaaaatgtctttagatgtgttctgtgcagagaaggttagagataccgcaacaggtgctattgttcgtacagacatttctgtacaggatttcaataagcgtaacctgatgatcgtagacgatatctgtgatggtggtagaacttttatcgaattggctaaagtgttacgtgctcgtaacgcaggtaagattgagctatatgttacacacggtatcttttctaaaggtcttaaagagttaagtgagcactttgactgcattcattctcttaatatatgggaagataacatccaagaagattccggtgttcttgttaagaatcagtcagatttgcaacaacaaattgtatctccatacgtgtgggaatttttaaaaataagtgttgacaatagggagtatgcttagtaagatactcccacactaacaaacaaggagacataactatgaatatttttgcaccttttgctactgattggtataaacctggtcacaagcagatgtacaaccaaaatacaaaactcattttctctaatttaactcctcgtaatgataaaaaattagagacactatgcagatcgtgaagcacgtggtgtcattgttttaggtattcgtcgagcagtaaccgatgctcttgtaactatgtgggacggcttctttaaaatgttcgtagtgcagcagtaaataaattttatcgtatgtctaaaaatgcattaggtgcttctgctccttctgctgaatgttggggagaattgcacgatttaggttatcttccgctggaagttcgatctctgccagaaggtgttttgtgtcctattggtgttcctgtgtttactgtgcataatactttagaaaaaattcttttggttaataactatgtggaaacactgttgtcggatgaaacttggaagacaatgactaaagccacagcagctttttagtataagccgtatcgctatggcatatgcgatggcaacgtgtgataatattgatcacgttaacttccagtgtcatgattttagcctacgtggtttaagtaatatcgaagatggttataagagtggtatcgctcatttggcatctttcacagggacagataatattctggctattgaaactgtgcatgattattatggtattgattatgatcagtttgttgcaggttcgattccggcaacagaacattcagtagcaacgactaacattggagctattgttgaagatctgaagaaacatttcccacatcttaaagatgatgtagatgggcttcgttatgtagcagaaaaagagtttcttcgtcgttatatcgaagaaattgttccagaaggtttttgttcatatgtagcagactcttatgactattgggctgtattgactcgcattctggtagaattgaaagattccattatgtcacgaaatggtcgtcttgttattcgtccagattcaggagatccggttaaagttgttgcaggatacaatgttgaatcttttgataactatgaagaccttttaaataatggtattgcgacagccactgaagtagttcatttggctgatgttaataagtattacaatgttcttcaggattgcagcgttgctgattgtattgatgaaacttatgagattccttattgtgaagcagtaggttctattcaaatcctttgggaagtgtttggtggtactatcaaccgaaaaggctacaaggttcttgatcagcatatcggtatgatttatggtgattctattactgttgaacgagaacacgagatcttacgccgactgaagaagaaaggttttgcagcttccaatattgtatttggtgttggtagttatacttatcagttcaatacacgagatacttttggttttgctgttaaagcaacaggtagtattatcggtgaacacgagattttggtaagtaaagagcctaaaactgatcctggtaaacgctctgcaaaaggttttattaaggttgttaaggatgccaatggtaatctctctcttgtagataatctttcttttaaagatatccaggatgaagacaatgaattacaagttatcttcaaagatggtaaggttattacaccacaagtagaaggacgtgatgaaacattcactgatatccgcaaccgtgttgacgtagaggttcttcgtactatgggaaccatccaggttgactaaataaaaacttcgtgataagattaaggtaaggagagcctgcaactgccctggatgggcttcacgaaggatttatgaaacaacataatttttattttcgttgccgagcctgtaacagacacttgactaatcattcccgtagagacaggaatggtaatattcaagagtcggatctatgctcgatttgtacaagtttggcattcgacgacagtcccgaaagggtttatcaacatcaaagtgtaactgatcttcttctaaattacacagcaccagaggaggaattagatttcacataattaaggaaacagtatgtctacagaaattatttttggcttatctgtttttattgctcttgtatcttttgtatgcggttatacattaggttacagatcaagaaaaaatattgtaaaaactagttgacaacatagctagttatttgctaagataagcccaagttaaacaaaaaggagaaaactatgacagaacgtatttatggtaaagaattgattgagaagcacgtattgattgataataaaggtggagcaatctttatttttgaacctgaatcagttcttactgaaaacgaaaatggtagcgttagccttaaaacagaaagtttggtaattgatttccttgctcttctggatgaaatggggcttcctcacgaagaagaagcagctattgctttgattacggttcttctggagaaacgcgaagctggtgaaatgacccagtatgcttaatactcaaggttccatagctcactgacgagagcgcacacctcataagtgtcgagggcagggattgtaaccctggggaaccaccatttaaaaggaggtgctatgcatctcctatatgcaagtgtggtggaattggtgatacacattgtgcttaaaacgcaacgcttaaatgattgagggttcgaatccctccacttgcaccaacgcctagtagggtatttggtaattccgaggccatcaaagcctgaaaaatatgttagaccgctttgtctaactaaatacgaaatatggttcgattccataactaggcttcaatttaaatagcaatttttagtaaaagtatcttgacatttacttagttttttgttatagttactatgaaaacggggtgtatctcacctgacttctaatcaggcgttaaccgagtaattggagtatgcaggttcgaatcctgtcaccccggccaaaaagttttaaaaactacttgacaaacaagatagttttatgttagagttaaaatacgataacgggaaggtagggcgcagcggtgcgcaaccaggtttgaaccctggcccattgtagcgatacggtgatggttcgactccattatcttcctccaaattcaactaggagctttatgaattataaaactattggacaggttgttaccggagttaagattgtaaataataaagttgtttatgagtattctaatcttcaacaatctgaagatggtaagaatattcgtatggtaaaagcagaacaaaaagattccggttgttttgaataattaaaaacggtagattggtgaaatggtagccacaacagtttgctaaactgtcgtcggaaacggcgtgtaggttcaagtcctacatctaccgccaagttatctttaatgtagcttgtaatcttactttaatagagtaaactttcggcagatggccccaaccatcttaccgacacatcatagtcagtggtgcgaacactggctattttaaagataatttatacatcgttagcttagttggtagagcaaggggcttttaactccaaggtcgaaggttcgaatccttcacgatgtaccaaacacgtaggtatcgcatagcggcaattgctggagactgtaaatctcttgcccttcggggcttcgttggttcgagtccaactacctgcaccaaattaaagatggattggcctagtggttgggcgacggactgttaatccgtgaacgaaagttctagcaaggttcaaatccttgatccatcgccaaatagtgcttgtagagttaatagaaacctctagaattttctagaattgtaggtatcaaatcctaccaagcaaatattttgctcctatcgtataacggctattacggttgccttgtaagcaacttatcagggttcgagtccttgtgggagcaccaattttaactctaaaggagtgtatgtgacagaaaaagagttagagaaatattttaatattaatgttttcgatggttttgatgacattgaagatgttgaaagatattatgaagtagagttagataaggataacattgtaattctttctgccacttatgattgtgcatattatgaaggtgaatctcacgtttatttttatgatatgaaaacatctttgttttatgaagtacacgcatatcattgttcttgctatggcttagaaggtcagtgggaacctgaagaaataggtgatttgagctttacggttgcatatctaaacagacgtggtgcatctactattttaaaataaatattaaaagcctcttgacaaaggggctaataatatgttagagtaatattgttaagcgggtatagtgttaatggtagcatatgaggtttccaccctccaggtgcaggttcaagtcctgttactcgctccaagattatttaaatggaatcgctagagaaaatttctcttttcgctcatggttttctccttcaaactctagcggttctttttaagtgattttttagttttattggagattagcctagtgggaaggcaacggcctttgaagtcgtgatgactaggttcgattcctagatctccagccaatatttacagtgcgtagcgcagttggtagcgtgggagctttggatgcttcgggtcgcaggttcgagtcctgccgcactgaccaaatttgcagagatagctgagacggattagtgctaccctgaaaaggtagaaaggatggatcgttaccatctctctgcaccaaataacaccatccaaggagtatacttggttaactgtcaatagcacattgaggcttcttacagtggtgtacttattatggctaagtggtggaatggtatacacgatacgcttagaacgtattgccccaggggattgtgagttcgagtctcaccttagctaccatatctaagagatatcatagggtttgcaacggatatccaccgtcctgttaaggataccacgccaagacgggttgtaaagggttagccattgatagtgtgaagctggcgtttcgagtgctttcataaggcattgcgagaagagttcgattctcttactatcaaccaaattattacagattgtgcgggatagaggagtctggtcgtcctcgccagtttcatatgctggagatcatcggttcaaatccgattcccgcctccaataaatacatcccttctggtgtaatgattaagttacattgacacttcaaggaactcatagccgggtagatttaaaagagtatggtactcaatatggctccaaaccatagatcaaggggttcgattcctcaccttgctgccaattattgtggtatcgtacagatggttagtacactcgaccgataatcgagaaacaacggttcgactccgtttaccacgaccaaactccgtgccagcggtgtcttcgaagaacaagcctagttccttctgagatggaggggtgcgactccttaacgcacaacatactactactaaatacttatcaggagatatcatgtatactttaaaagtaattcgcaagtttcctcaagaagaggaagtaagaatttataacactgtaccattcgtagtaaatgaagaagaattcttttattgcttagaagatgaagtaattattcaatatcattgggaaggttacgacagacaagatggtgttgtagcttctgtgcttgctggtgacagagtgttattcattcacaaaactgaatcagcatatctaatgaatgataaaggacaaactgttaaagtaattaacagaccataaagaattttataaaagcctcctttttggaggttttttattatctataaaataaagatctttacaaaacgtataaaatatgttatccttaagtaaggaggtgcatattatgcctaaattgaaaagaggtcgaggtagacctacagccgaaatgcaacagatttatgctatggatgctgcacaggcgcaagtaaaagaaatttttgctggtcgttatttagatgctatgcgttacattgcagatcttgttgtagatgaaaaggcttctgctaatattaagttgactgcttctaagatcatcaaagaacaagtagaagaatggctggaagaacattatgaatctatggaagaagaagatattcttccagaaaattctccccctcaaaaaatcgttatctaattctcctctcttgggaactttgttcccccctctccttgttaattaacacccctttccgaaaggttagggggttttttattttatacctattgcttttatatatgtttttatgatatgattaatacaggaggactataaaatgagaaactatgtagctaaacacgattttaatagggcttcttatcacagagataagaagaacagttattcgcgtaaatgggatctggaggaagagttagactatgattacagaagaacaatggaaggagattttggagaatgcacaaccgatggtagtgaagaagatagttaataattcaccaaatctgcctaaagtaaaatttaaagatgatgatactgactatgttaataaacctactgaagaataaatgggttaggtattttgttcttattatagcactgtttggtggtttgtatgttggtttaaacaaattacacgatgacgtgtatgcacaaggctacaacgcaggtattgctaaacaagaacaaatattacaacaaaaccaaattaaagcaaaacagcaattcgatatcttacaagcaaaagcagattcagaaagatctaaattgaatgaaaaaattcattcattaacgaaacaaagaaatgatcttcttacacaactggataagaagagtaataacataacacaagagagaatagattatgcgaaaacatcttctggcgctatgtcttgttttagccctaatgatgacgggttgcgcatcatcaacaacagcttcccagcctctattgattgagcagtgtaaagctgtagcaacacaacaaataaaagcccctgattctgtcagtatggaaaaaccatctacccctgttttatatactcccaatcaaataaagaaaggggttacaagatcagaggtagtggataatcaaactttaaacaacgctttgtgggaaaaagataggataaaacttatcagtttacaaaactatattaaaacattacaaagtgaaggaataatttctaattaggaggagatgtggcaaggaaacctgtcaaacaatcttttgaaaatgtagatattgaagttaaagcccaacctggcaaacaaacattagctatggatcttatgcctgaagtaatgatttatggtggtgcggcaggttgtgtttcagcagaaacagaatacctaacaagagacggttggaaacaaataagtgaatatgatggtgaggatatttatcaatacaatccaagaaataaacgtcttgaattagttacaccatcttttgtagaatacgatgctaaagataatctgtattgtatcacaaacggagtaggtgtcttccaagaattaagtatggaacatcgctttgttttctacaagaagaaaaaatccaaaaaacattttgaaattcttgttggggatcttattgcactacagcaagcaggacacccattacgaggatatattgaaaacccttttggtaaacgtgttccgtttaacattcaaggtaaacctagcacatacctaaaaattcatgaggtaatgacaagtgatgataagaaatattgctttgaaactccaagcagttatgtcgtgtttagacgtggcgatcacatcttcgttactgggaatagcggcaaaagccgtctgctacttctaaaggcacttaaatacgcatataaagatcccctgtttggtggtattcttttccgtaaaaatacaacagctttgcgtaaatctggtggtttgtttactgaagctaaaaaactttatctaccattaaagcctcacgtaagagaacaggctatggagatggagttcagagccacaaaaggtggtacacttaaatttgaccatcttgaaaatgataacgtaactgctgaaactaaccatcaaggtacacagtattcgatggtggggtttgacgaacttacacattttacacaatatgtatagcagaaactggttagggcgtatgcgttctgaatcagaaacgtcttttatgctgtgtacttgtaaccctgatgcagatagttgggtgttaaagtgggtacttccttatttggatgaagctggttatccacgagaagatatgtgtggcaaacagctatacttccttattgtgaagaagaaccagccagtgtttaaacaacaggcagaagagttgaaagaaaagtatcctgaaaactgttttatgcaaaacccaaacgcaggtgaaacagtggttattgaaccacaaacatgttcattggtggtactatctatctttgataaccctgaactaataagacttaaccctaaatacttagcttctttgaaggctcaaaccgccgttaagagagcacagcttttagatggttgttggtttgctcgtgcacaagaagagagtttctttaacagagaatggttacacgttatcaagtttaaagatttaccaaacaatcttaaatatatgcgagcgtgggataaagcagtatctgttccaacagaatcttatcgttatcctgactacacaacatctgttaagatggtttctgatacagatggaaattattacatttttggtgattatgattatgatgctcacgatgaaggtagtaaaattttttgttaaatccaaagactaccaggtgatcgagataatttaattctaaaccaatgtaagattgatggagatgaagttacagttgtattgccaaaagatccttctggtgctggtttgattgaatatacagaatcagctaaaaaactaattgctgaagggtttgttgttaaaccagacgctatgcctggtaacaagaaaaaactacaacgctttatgccatttagtagtgcttgtcaaaacggttttgtttatattgtagaagaatctttccctaacaaagaaactcttgatcatttctataaagagatggagtcgtttaatggagaaagatctacagcaacattaaaagatgatattccagatgctgctgcatcttgctttaatactttgtcaaaagaacagatgtttaaagcagtagcaataccttctgcaacaaatgcattaacagggtatggtaagatgggtggaagatcaagaaactctttatcttctccatatagtatcagaggaagataaatcttgacaaaactatttaaaatatgttaaagtagcattatatgtctaccccttcaatggggtagagtcatttgtccagcattagcggaggttctgagtgtctacaggtaagcgtaagtacactaaaagatcggattactggaacaaaggctcaactgaaaaagctgcactgtctccaacacaaagtgcaactaaagagaagaacttggtactttcaccagaaataggtactattggtcttaattcgattaaagcctttacgaacttcatgcaaccgtatgaaactcgcttcccagaaaacatccgaacatacaaagaaatgggtgaagaccctgacgtagctactgctcttgatgctacgtacatctttgtagatagagcattctttgattttaaaataaaatacaatgttagttcagctaagtcaagacgtgctgcaaagtttgtagactacacacttcgcaacatgaatgcaccactaagacagtatgtacgctccttgctaacatataagcaatttgggtttgcatttgcagagaaggtgtatgaacttgatgaagatccaaaaagcccgtattttggttattaccgtcttgttaaattggcgtttagaccccaggatacaattgatttggcacaacctttcacttattctgatgacggtcgcactattcttacggtaaaccaaaacattactaatggaatggtaagccctggtactaacgcaactctgataggaagaaaagaaattcctatggagaaagttatttacgtagggagcaacattacagagaataatccattaggtgtaagtccacttcttgcagtatatagaagttggcgtgaaaaatctctgattcaagaatacgaagttgttggtgtttcgaaagacttaggcggtatgccagtgttgatggttccaagtgatattctcaacagggcatcactaaacccaagcggggatgaagcacaatctttacgtgttctacaagcaaatatcgctaacttacacgcaggtgaacaatcttatatggtgttaccttctgatgtttatgaaggtactgttatgcgccagtatgatcttgtattccaaggtgttgagggtagtggtaagcaattcgatacacaggctctaataaaacaacgtaaattagatatctacaacagatttggtgcaggtgttctgattatgggtgatggagaaggtggtagttattctttgtcagataacaaacaaacccttctttcacattttattgagcgtgatgtagatattattacagaagcactaaatactcaagtaattccccaacttctacgtttgaatggtattttcttatctcaagaagatatgcctaaatttgttagtgatgatatcggtgatcctgatattgaagttaatgctaaggcaatccaacaaatcgtagctgctggtgcaataccattaacgccagaagtaattaatgaattcttcgaacgtttaggtttcaattatagaatacctgatgatattgttgctgatccagataagttccaagaattccttgagacttttatgccagataagacttcaagatctggtgatggtttagcggctggtgctggtaatggaacgtcaacatctcctgctgcattagatacatcggcagcaaatttggcaaattaaaaatatttttaaaaattttttaatttaggtattgacaaataagcaaatatcctgtagactaagatttatgggatatttgtttttatgaggaaccgtatggaacttaataaagacacgctttgggaactctataaaacgttcagtggaacgaaagagaaaaagcaaacccaacaaaattccactccagaagaaacacctgctactatcgtcaaacaaaataaatttgacgaagaaaaaatgcaagtgattgaagtgatgtattgtccaccagaacacgatgacctccacggtgaacgtatgtctgaaattgaaatcagaaagatggttgacaacttcaacgcaaatattactaacgtaagtggtaatcttggtcatatcaaaaacaccgataaatttaaaccagttaaggcttgggttaatgaagtcgattgttatattggtgacgagtttgttgttgaaggaacaccactcgttaaaattcaattctatgatcctgaactgtatgaagcaagaaagaacggcgttcttaaaggtttaagtattggtgcagtaggatgtaaagtgaagaaggattaattgtggcacatacatatctagctgacgtagacttttcgggtaaagctacggaagattcttgcggagcacacattgcttacaccttcgattttcaaggtggtgctgcttctggctttaatacccctctactttttaaatctggcgacaacccagacattagcttcactaagttagaagctctagaaaaaatgggtgaagacgttactgaattacgtaaatcctatatgaaccaaattatgggatcattatctgatgccgttcgtgaaaaatacgaatctggttgggattgggtttatgtagtcgatgccgattttgataatggcattgttattttctgttctgactatggaatgttctctactgattttaccattaacggacttcttgttgaagttggtgatgttgcaaaaccagtagtacaaacaacggactatgaagtagtagacggtgatgttttagtttccctggatttctttgataacttgattgatgatgctctaggtgatttagttaagagcgcaattaagtttgatcacgtaaaagattatttagtaaaagctcacgaagctcgtactaataaagactctgtgattgcagaggataatccagcagatcttgaatctgcaaacacaaccgatataaataaaggagatacccctttggaaaatattaacaaagaagaattcctgaaatctgctgaggtgcaagaccttattaaagcacagattgcagaagcggtagaaaaagctgctgctgaagctcgtgcagaggcagaagctaaagcacaggaagaaatcaacaaagctaaggcagaagccgaagaacttcgtaaagcagaaattgctcgtatcgaagaagactataccaatgtaattaagtcttatggctatgttgaagaagacaaagttgaagcacttgttaaatacctagtagataacaaagaaattgctgaaactgttgttaccgcatttgaaaaagctcgcgaagaagttgaaacagttaagaaagaatttggcaaagaagtaggtgttgatgttgaaaacaaagaacctgttgctaaatctgcttctgaactgattcgtcaaaaagctgctgaacttaaaaaagcccagaaataatctaaggagatttaattaatggcaactggaatttctttatcaaactaccgccaggaatttggacaccttgttctgggtggagtatttagttctgacctaggtcactgtgttcgtgaagtgaacctggttaaaactgcaaccatgaaaattggttctgtactgaaagctgacaacacagaagctactgctgctggtgaagctgttaaagttctgctgtggactgacgcactgttcgggatcgatgatgttgcagtaggtgacactttcaccgcagttgttggtgtacgtgacctgactctcaaccgctatgcagtttactacaagagtggtgatctgattgatgacgctggcgttgcagcactggaaactcacgatctgaaactgactgaaaaagttgttttcacttcttaatttttaataggagatttatacatgccagctattatcttagatcaggttgttgactttagcccaatgattgagctacaagaaactcctgatacacttatcgcaagtctgaacctgttcgatgttcagtaccatgctaccactgctattgaaattggcagacagaaaaatgcagatggtctgatcccagcacgtgaacgtggtggtgagcgtaacttcctgactatggacgctcctagcgttaaagtcttccgtattccgttcttccctctggataagaacattaaggcacaggatattcaatccttccgtagcttcgctatgggtggcatcaatgataacctgcgtaccgaagcggaagttgttaaccgctatatgactcaaatcctgcgtgatgttgcaaaaactaaagaaaaaatctttgcagaagcagtgatgggtcgtgcatacaatggtgttggtggtgcagctaactctgcatacaactggtacaccgaatggggtgcttcccagaaatcagtatctgtagatttctcttctactactgtttctccggctgctaccattgagcaagaagctcgtgcatacatcatcgatcagaaacaagacggttctaccgctactcgtatcgttgctctgtgctctcgtgagttctttgcttctctggttaactctccgtttgttcgccaggcttatcaatacttccaaggtactccgaaccttctgcgtgaccgcctaagcggtaatatggatgttcaggtattcgaatggaacggtgtaacctacatcgaagatatccacggtaacatccctgctggtgaagcgtttgttctgccaatgggtatcccagatatgttccaggcgcactatgctccagcggatactccagaactggctaacactgttgctcgtgatctgtatacctttatggtatctgaacaccgcactgtacagctacagtctgaattctccctgctggcggttaatacccgtccagaactggtagttaaactgactactgcttaatccttaacgggattctaaaaagcctgccccttgcgggtgggcttttttattatgtgtcccactaacaatgagaggaaacacgattatgggtaacgctgtactgaaaacatattttagctaccatgaaatgattatggattttgcttcactatctcctgcattagatgcaggtaagacacttagtgttgctccacctatgtcattctatactacagatggtagagtagcccttggtggtaactttattcacttcttagttcgtctacgtgaagagacagggattcaggttcatcctttcggaagtgaagaacatcctggatactatctcgttagctatgaagattatgcaccagtagaattaaaaacgcaagataaaattgaagttaaagcagtagacacaccagcaaagaaacgtgcacagcgcactaaaaagtaatgggaggtttacatgcttgtagctagtgaactagtacctatgattcgcatattggtatttaacccttcacaagaaacacttcctgatgcaatgattgaacaaatcattcaaacgtggatagatgtgttagggaatgatgatgccaataaatgtgctgtactttggaacagtctgatctctgtacttgaatacttgtggaatacagacgtactaaatcataatacacaaacaggtggtgctctttctagaaaagagaaagttggcgaagtacaggttgaagtaacctttggtactggacaaacagaatacatttcaccttgggaaaatatctataaaggatatcttgatggtgatatgatgatacctggttgtacttctggtagaggtgtaacaagtaaagtattagttggtggtgttgatgctcgtgaaattgatcgtgtcaacagtgatcctaattcagtaaatggtttaggtggtgttggtagtgtagatcgacatacgagaaatatcaagtatgccagaaactatggccccattggttactacagaagggataaataatgaaatgtgagatcacacgtggcgatgatatgtcgttagatgaatactttagtaaaatgctggctctagataatatagaaatagacgctggttttcttactgctgttcgccatccagaatcagatctcactatccctgcaattgctgccatacaacagtttggtaatgaaacaaacaatactcctgcacgtccgtttttaacggatggtgcagtccacgccagcaaagagatacctaaacattttgatgaagtgtttagaaattatttacttcgtggaagaggtttagctgcctttgaacctattgcaaaagtttcacgagaatctattgctaaagcgattgctttgcaacgttacagaccgctatctcctgtgactattaaaatccgtagagataaaggtaactactcttctcatattcttattgatactggacacttaattaacagtattgaatcagaaatcaagaagggtcgttctaaaaaataacttgcaataagtctgtttttgatgtatactaaaaaggagatacaatgctattagaccaatttactctccttgatctaacaacgtatcagggtcgtaaaagaacctatgttcaagatcctgattcgccaatttccaatatgggtaatacagtagcatacgaagactttacaatagaggctgcaagtttgcaaccaatatcaggtagaacacttcaagcactgccagaaggatacagatctaaggcacaatatagcttctggacaaaaacagaaatcagaggcatccagcaaggatcagatcaattatctgaccaaatactaatagatggacaatggttttccatttattctttgaaagattggacaagaacatctttcttaatacacacacattgtgttgctattctagatgaccagaataacacctattcatattctgaggagggtggtaattttggctaatatctatgaacaaattgaattgtatgaaaatacgatattattaaatatcgctaagttcttacaaagactagtggggcttccggtttatgttatggataaaccatttgttaaaccaacaaccccatatctgacattacgtattgtatcatctgatgattcaggtggttggtcacaaaaatattcttttagtgaagatgcgttttcctatctaatggacaataagtatgaaatagaacttatggcttttagaggaagaccaatgacacttttaagttatgttcttgcggcacttcgtggtgcagatgaattaaaataccagtatctttattccaaaggtattagcttcttgtctgcaacaaatgttgcacaggctaacactgttctggatggagataaaactgaacaaagagcgagaatatttcttacattcaatactacgatggttattgaggatttagtaactaccgaaattgaagcaattaatatgaacattcattcgttcagagatgattacgatgatcctactccaatagatcttcctttggataagatttacattgttgctcacagaagtaaaacttattactttacgacgactgatgatggatcattaattaagtatatcccaacggataattcattggaataaagtttctaacaggagcataaatggcaacttttcgtgataaggtagtttccgtaacccttacctacggtgctacttcaattagtgaaacacagtttgatatccctctaattcttacagggcataacgttactggcaatcttgtagattatttcacttcttcagacgcacttctgcaagcaggttttggcactgccgatccagcttataaaatggcaaaactactatttgacggtctgttcgcaccagaacaagttatcgtcggtaagcgtgatgtttctaaaacaactctaactccagtagttgaagatagtgcaacttacgttatcactattaaagcaaattcaaaaagcaaggacttcaagtttgttgccgatgatactgcaactgctcaagagattgttgttggtttaacagaaatgatcaacgcagacacagtgtataaagaattcttcactgtgtcaaatgatggtagtgttatcactgtaaccccagttgcaggtaaatacgctactatggatagttcaggattcacaactaaagtagaatatgcaaatgatatcttagaagatattgctaaaattgcagactatgaaaacagttggttctggttactatctgattctcacgcagaacaagatattatcgatctagcaggttatgtagaagagcatgataaagtgtatttcttctctacctcgcaaccaggtgttctaactaaagaagaagataacattctagaacgcttaggtgatatgggctacaataacacttgtatggcattgtggatgactaacgctgatacagtgttcccagaagctgctgtagttggttctatctgctctgcaacaccaggtactactaccctgcatggtaaaacccttgttggtatcgagattgaaaaacttggtcagacagcagaaaactttatcgttcaacagaatggtaatatttaccgtaaagaacacggtgttctgttctaccgtgatggtttcatggttagtggtttctatgttgactatgtggtacacgctctgtggtttaaagctcgcgtagaagaatctctattcactctatttaaacagcaatctatgcttggtagcggtgttagagcaacttctgctggtcttgctttgattcgtcaggctgttactgcaaacccaatccaagtaggtattaacaatggttctattgccaatgaggtagtaacttcagaggaaacaggacttctggtaagccttaaacctactatctatatcccatctcgtgcagatatgactgatgctcaaatcaatgcacgtttggttgatggtatggttattgaatacgtatatgctggattcttccactatgttaaagtgcaggtaaacgttctgacgaaccgcactgcaaatagccagaattccaatagctctactgtatcttcataattaaaagcagcgggggaaaccccgcttatatgaaaagtagtataaaaggagatccactttggataaaatgcttactggcgtaatggcctatgatccttctcaagtaatcctgtctttgggtggttgggaaccttggggtttcgccgcagataccaaaattgttattaacaaaactaacgatatcatcaacccatattcaggtactgatggtgacgtttccttggctcttagtcgtaaccgtttaggtacgctaacaatgtcactgcaacgtacttccccagcaaacgaagttcttgctgcttatgcacaaacgatgtattctactcgtcaagtagcatttagcgtatatctagaagaccctcgcggatattatatcagcacaattggttggattcaaagccaaccggacgacactattggtgaaactattcaagaaaaccaatgggtaattggtcttaaagatgcaagcctacttcgttctactgtaggtgttggtgttaacgcacttaactctattagtgctctaactattcagtaacaaaaagggcagaaatgccctttatttttaaagagaggaaataatggaacaacaaaaagataatactattgcaaaatttgctcgtccagaagtaatggttgaaattgatctggatgaaggacgcagtgtaaaatttagagttctcaagtggagtccaactaaagtttttgaaaggattccagaactaggtagtgtactagctgttcctatgacaatgtataatactgctcttatgtcagcagacgaagatctagaagctcgtattgctatggcgctgatccaattattcagtggtctggaagaaaaaaacttagccacattcttacgtaaaattttagatgaagtttacacagaagcaggtcatagtgtttccgataattttgatgaattgttttttgctcacccagaattagttgttgacttagctgcaaaagttcttgaggtgaactatgccccttttttcaaacgaggtttcggaaaactgttgacccaatttcaaggaatagagactctagcgaagagttaagtccggcaattaaatcagcaattgaaattgcctcacaaacccttagcttgacatggtatgaagtaattctttgtaaggtaattaagaatacctccgaaaccttgtcctcgttagataattacggtgtagattatctacttaaaatttatgaatatttaacatttgaagactatgtacaagatcttcacgttaaagatgcggatattaaacgtggtcaacagagaacaataagagaactggatacggctatgaaaaaattaattccagattcataagtaatacggaggattacccttgttagaaattaacacttccaagattaagaatacagtaacgtttactgtagataaagacagtttaaaaaatactaaagacgcaattaaaaaccttaaaacttttacagaatctattgaaccatctttaaatatgactaaaatgcgtcgtcagtttaaaagtatggaagagtatgctaaaagaataaggcagcaaatgtcaggtcttggcggcggtaatcctccaccaatcccaccaaccggaggttcaagtggtggtggaaaaggaggaagtggtagaggtggttctggatcttctggaggacgtaagacaccggaggaaagagccgcagaagccgccgctaaacgcgcagcacttgctaatatgaagcaagacgattttagttttaaagctatgccttttacaaaagcagacagtagaattctagaaaaatctaaaaagattgtagaagaaactgttgaactttatcgtaaaggtgtgattactagccaacaaatgaacaatactttggctagacagttagaagaactacgcagatctcatagagagaagaatgcacaacttcttgatgaagagagagctagacgtagaattgcccgtctgcaagaagcagaagataaaagaagacagcgtgttcgagaaagagaaagaaaggagttcgaacgtcagcaaaggagagaaaaagaagcaagacagcgagatagacaacgtaagctatctggtgtaggtaatgctgctattgctcttaaccctgctatgtttggtgttgctcttttaggtgctggtttataccaaggtataagcaaaatcgctgaaagtatcgcagcttcggcagaacgtattaatatggttagtagaggtggtcagaacgtacaggtaaaccctaacgcaatcctaacaatgcgtacttggggtgaaatgaacggtgtagactctgctagtattattaaagctattgataacattaaagacgttcgtgaacgtttaggtaacactgtactccactctgaatttgatgaaaaatcaggtaagtggaaaggtggagatagtggtattaatgaaatcatgaaccaatttggttggtcgaaggaagatattgctaaattccagaatagacctctagattttgttcaagccctcgttaacgaaggtcaaaaaagaggaatgaactctgcacaaattggtcgtctgatggaaaaccttggtgatgacttaatgcactaccaacgtatgtttttggacaatggtaaagagtttatggaagtcctgggaatgttaagtaattcaggcgcaactcttaacgacgaaaacatccaagcagcacaagactttgttaaactaagagcacaaattaatgcagcaggagaaggttttaccaataacttacttgtagggtttatggatggtttaaaatctgcaccagattttgcagaaaatatgaaaactttccaagaagctgctcgtggtcttggtgaaatgtctggtagtattgtaagtagccttgcaaaaattgcgaaatatttccttgatttttcaaataaggttgggccaaaaaacaatactaaagaagctgtaagagattattataatggtacgcagtatgggtacgatgcacaggttggtggtaatccttgggcttattggcctattggaagagatcaacataaacctgaaaatcaacctttaggtgactttgatagtagtttcttaactagtgccttaaacccaagtgcttctagtatcggttacaatagacctgatttaacagcatctatgctaacaccacgccaaggtgttccagtaccgttaagtgtagagaatacggttgttatcccagacaacgcattccagattaatgttattccagatggctatggttttagtaattatctagatgcgacaatgaataccagttttagtaacttctcacaaggtttaactcttcagttaagcagtggacaatcttctactggtggttaatgcataaagcctcgcttcggcggggctttttatttgtcttgacaaagagttgtttttcgtgataaaatgagtgataagggagaatgtttcttatcacattaagaggtaaaattatatggcagcaaacactccagaacaacacgttcaagcggtttataaagcggaacaagatataaattctacaaaaaacacaaataactctgcctctactgtgaaaggggagaatggtttttgtattttagcaagtgtttacaatagtgcaagtgatcaatatattcaaaactaccaagctatagtttttgatgctgttccaaatatcggtgtaaaacgtcaagcagatgttactagctatcctgtagaaaatggtgctaatgtatcggatcacgttcaagttaagaataatactttctctttatcaggaatgattacagagacacctgtaagattaatgcgagatatgctatacagtgctggtgttaacggtactcgtatcagtcaagcaattacttacttagataaaatatttgatgaaagacagcctatcattttaataacagagcataaggtgtatgagaatgttattttgaaaggcatatcatacgaatatcaaacagaatatgcaatgcaatttgacttggaatttgaacaagtaagattagtttcctacggggaaacaaatgctattgcacttaagacaaaaccaaataagaatacaggtgttaaaaacaagaaaggtactagtccagatgctgatttggatgcaagaacagggaaagcaactggtacagaacatcttagtgatcacagtgcagatggtaaaaaataaggagaaaatttttggctatttcatcttattcaaagatcagtagaagcacatctaatagtggctacaatgcggtatttattgatcgaaatttaggttattattcttggtacttacctacagaacagtacccagaccaaacatatacagtaactctcgatggagtagattatgatatacgtttgagatggaatacaagagatcaagcgtggcaaatgcaattaggattatcaggagacaaccctagtgtaacttttaaagtaaccaatggtttagatcttctagaaccgtataagtatatagaatctgtgccggatggtcaactttatttggtagatactgttaaaataaacggtagacctaattactatgacacaggtgtagataaaagatttgctttggtttatatcgacgctcttccatatcaagcatgataaaaggagtttttaaatggcagaagaaagaaattacacaaaagctcctgcacccaatctaaacagagcatacaaactgttaataggtacagctactaatactaaagaaaaaaggacaaaaaattcctctttcaaatctacagtagacttagatactaaactaggggatgctaaaaaatcaacccctaatttgtatgttattacggagcaccaaatatctttcacaataagaaaagataataataaagatcctaatcaagccgagataactatttataacctaagtgatgatactgttaattatattaacaaaggtattcgtaacaacttggctgttgctttggcagtaggttatgaaggtcaagagttaattatgatctttaagggaacggtgcaatgggtgagtgatacttttaacaatacagacagacgtacagtgttacattgtctggatggtggtattaacatctccgaagcaaggacaagccgaagttatccgaaaggtacaaaagtaagtaaggttgttaaagatttagttaaagatctaggtactacagaaggtaatattcacgtagacacagagaaaactttatcatctgcaacagctatgtgtgggaacacatcacattacttagaaagtatctgtaaaggtattgatcacaatgtgtcgatacaagatggatctgtttacgtgacaccaagatcacaaatgtctagtgcaagatgcgcatatattagtgcagaaacaggtttaattggtagtccagaacctttccacaacgatattaaaccgacacaaaaagtaaccaaatcttctaagaaagctaaaaagcctacagatggtgttaagttcagatgtgaaatgaacggtgctatcttaccagaaaaaactgtttggctcaagagtcataactacgatggtggttttaaggtggtgtctgttgttcatacaggcgatagggaaggtaaagactggacaactgaagtagagtctgtatctgtatctgcaattattaagaagggctagaaatggatgctttaaattttgtaacagcaatccgtggattaatcaacgaacaagttgcggaagtacatacatctttacctgtaagggtaattggtgtagattatggatctaagacagtaactttagaatctattgtaaaaaataccagatctactgaagatgaaatagattacccaacattccacgatgttccttttatggtaaatggtggtggtacaggtagaatttcatttccaattaaagcaggagatattggtgttgttgtcttttcagaaagagatccgtcgaatgctttccagacagacggagatacagccagcagcggaacattaattcaaccttgtggtttgtatccagcctgttttattcctaagatagcaacagctacagattcttctgaagaagtagattctgaaaaagttgttatctcaaataataagcaaacttacgcttcgtttgatcctaacggtaatatatctgtgtacaacacacaaggtatgaaaatagatatgacaccaaacagtatcgttcttactgatgcaggaggaggaaaacttacactgcaaggtgggactatgacatataaaggtggcactgtaaatttaaacggtttaacaatcacacctgacggtcgtatgaaagatagtggtggcattggtttacacacacatacacaccctgtacgcggtgttgaaactggtggtagcactgttacttccgacaaaccaaatggaggttaacagatgggaataccatttgatttaaaacttgatggttctaacgatttagtaatggtggatggtgatttaacactaaccacaactaaaagtgaaattgcagcacagacgcttggaataacacttagaactttccgtggagaatggttcctcaattctaattttggggttccatatctgcaagagattattggtgttgccaagaagaaagagattgttgatcgcattttcttatcaactattgcaagtaatgtttatatagataatattaattcctacacttcctcttatgatagagatgataggtattactcaatgaacgttactgttacagttggtgaacaagttgttagtgctctattcagtacacagccgtctgaagaatatatctatccagaagctggtgacgataatgcagcaatcacttgtgaagcatttgaaattgttgaatctgcaaatagactctatcgctttattaacattgttggtcttcctagagatacttattctacttggtggaatgagtggtctaacgaggcattgattgaaaaataccttgttaacgaagccaataaaggtcttgcaaccaattacaactatgctataacagcaacaatgggagctacaaataataatggctgatttaactacaatcaaggtgtctgatctacctgtaacaacatctgtttcagacacagattattttgtaacagatcaatcaggcatcactaagaaaacatcattacgtgttcttcttgcgggtgctggtgttacacgaaatcgtctttctgcaaggggtactgtcacaaataccctagctttagatattagcacggcagagtatttctctgccactttatctagtccaacttgcagtatttcatttagtaatgttccagttacaactaacattgttcaaaactttacactatccctacgtcaaggcagtggagcaaataaagtaacgtggcctcaatctgttaaatggagttttggtcgcgctcctgttttgagttataaacagggagctacagatatttttgaatttgttagttatgataatggagctacctggataggtagtttagtgatggcaggagtgatttaatgtcaagaattaagcacagaattgacaatgtttttcaactgatcgatggacatattcagttcttagatcgtaatacaggtttaactgtagatcctacagtgcaacactatgtattaaacccacaaaacgttctagctaataacagacactttataaactggactgctcaagaagggcaaccaaacggggatgctacaacagaaggtcaatccgtgcttattcttggttgcgcttatgcatacctagcttccggcgatacaaagtatttagactctgctaaaaaatattggcaagcctatatagattacttctttggtggtcaacctatcccagatccgccagcaaaatatcgccctaactggattattaacggtaaagaaccacgtcttgcacactatcctcttacagatgatggctaccctacacacggaggttttaagggtagcttaatgacgtggactaacggtagaacagttattcctcatggtgctcctcattggggagaataccttgacaaagcatggtttgcttttaatggtaatctaggatggaactctgtaaacgctacagtatatgctgttaatgcagatggtacaacagattggtctaagaagggagatcaatgggatgttgattggatcattgatcgtctaggacgtaaagttgactgggatggaaatatcttagaagaaggttttccaacatctcaatacggaacagttcaactaaaaaatacttctgtaaacggtacatataaatttaactacgcgacttgtaaccctgttgaacacggtggttatttaatggagcgtaacactatgtggcataacagaccagttaacgttccggtagaaatgggctttcaggataatgcgtcagatgccgaaacttggtggtgtgatgctaattacctgatgtaccaaattacaggagaaagaaaatattggctatgctggcagtcttcactgttagtgtgtcaagattactcaaacattgatatgtttgataaattcttccgtaaatctacatatgcaactattccttttacagatggcatctcttacgattattcgtatccatctacagcaatacctaaatattcaagagatactttaggttatattgttattagacaagatgttgctgctcaaacaacattagaacagcaagccatttggtttaaagttgatcagaactctaaattacgagttcagtttcaaggtgtagatgacgcaggacatggtattcttttccgtccagaattagaactaagtaagaccaaagatgaaaataacacagtaatttaccgttgtggcttaccactgggtacagccagtatgacaagcatggatattccattatccagctttatgagaagcacccctccgaatggtggaacatatattatcgcagatccgcgaattattgttgactggggtgacaatactgtggtacaatttaagtatgtaacaggtattgctggaactaataatgaccagattgttactgcatcaatggatatggatggtggtatcactgttggtttttggttaactcctacatcaaaagctaatgttaagtctattacatatagaacatatgaagatgactttaacatgactatcacggatgctcaaggttggagatggtgggctatgcttcctaaaacgcaaggggcatggagtacgaagactttatcagcttctgattttaagttaagtgcttaccagcctaatcatccagaaacagatcctaaaccttcagcaataaatcttactgcggtagatcaggtaaatttagttctcgatacggctcctgtcaatggtttaacaggaacaatagatttctattgtattaacgatgtacctgaaagatattcgtcatcttctggtgatgattataccatgtacttccgtattactgtacaggcttcaagtcctcatactgctaagttaggtgattgtactattattgactataagttaaatagtcttaattacacaccaggaataattccattctctaatatcagtgacccaaacactgcattgtatgatggctggcgtggtattccatacccaggataccagtatccttccttatactgttttgcaggtagagatattgattggacgcgtttaaacaacagtatcaatttcttgtatgatgctcaaatgtggttttataacacgtttgatcctgtgatgcctgggcctatggcacaagcgtatgtgtgggatcgttgggatgcaagaaaatatggtgaaccgaatacgttcacaatgaaacactggaatgaaaaagcgtgggatggttatgaagctcgtgcattctactgtgcttgtcatgctgtatacgaacttgtacaaagaggagaaacacctcctgaaaaactagtaactgtttgtaaaaattggatcaactaccttaaatggttccaagacaataatgatggaagaacaccaactatctttaatccagatggtacagttcttgcacctatagatgactttactagtcatatgtctgcactgtttatggcgggttgttcaatcatgggcttggcaggttatgattcacaaattccaaacattggtattgtagcagacagatgttttgatctgattcagcaaaactatattgtgctttcccctaaccatccgatgaatggttgctggagtgttgcaccacgcccagattcagataacggaatgttctttggtttccatgctggagaactattacgtggttttggtttatatgccttgtatcgtaaactaaaccctcaaaacgctttaccaattttggataatagtaacataccaacactaactgttctaactatgaatgatattagtgttgatgtaaccaaataaggaaaataatgaaacaggctatttttactgtaactcgaaatacgagagtaaatgccagttcattcagctataagaccgtcgatggaacggcggtcgctggtagagattatgtagctaaacagggaacagtaacgttcccttctgatgcagattctgctactgtagtggttgatgtatatgaacgtccggcaaactctttagatctttattttactcttgagattactagcataagtcaaaataacatgatgatcaatgaagaaattcgttgtgttattacgactgatcaatcgaatacaaccccgctaacttggcctgttgtgaagtctagaatgtttgatcctaagttttggacaatagattctcaatcaacagaaagttgttctattatctctaatggtgattctttcacagcaagaatggttaataggacagtggctggtcttgctgggattatttggtggacttacgataaatatgatcacaaaggattaggctaccaagaacattctgatttaagtaaagagaaactttggtttaaaatggaacttagtcaaggtgttcctggatttaaagaagaaaaattaatgccatccttaacagtgacactgaaggatgaaacagttcattatgtatctctaaacttttatgcagaagaagtttcagaggatggtaaaacagcaataattaaattagatttctcaaacttaaaatcggggccagaaaatgatattgttgttgacactacacaaatagataacatgttcttctccttgatctccgcaaggtatcaagaaattgaagatgttatacctgtagacaatatggatctttcctttaagtttaccatactagagcctgatactggttacagtatgatgaatatgggtaatttaaatgttccggcgcacaccataagaatgtgtacatcttatgatgatatgtataacctaaccccagagcgagttatttctaacacctacagattaggttatagggatatgattaaccattataatggtatgtcacactattatcaatttagttgggatgctggctctaataaatgggctttgaacagaacagaatatttaaacccagcaacagaagcctggtttgataatttccacgctaatgcaaaagctatgggttacacagtaatgaactccttaagttttgaacttatgagtacagtgtgtcccgtagaatgggtacaacatacttggaatgatgatctggctgctacaggttatgagccaccaagttatgttttatctccttcaattgatgaagggatgaattatttacaaggtgtaataaataagatagcttctatatccgctgctaatgatcttccggttattattcaggttggtgaaccgtggtggtggtataatacagctaccaatctaccgtgtatttatgattatacaaccaaagttgcatttaataatgaaactggattatatgcacaagatgttggtacggttaagaattataaaactggtacaccatatgatgaatattatgcattcctatctaaaacattaggactacgtgttgctaagtttgcaacggatactagattagcatatcctggagcgaaagttacattgttaccatttgtaccatccatcttaggtaacggtatgatggaatttgttaacttccctaaagattattatatccccgaaaactttgacttttattgttcagaatgttatgactggttgttggaaggtaagatggaaagatctttcgacgctatcacaatacctaatgagcaactaggttttagttatgataagataggttatatagcagggtttgttccagatgcaactctagcaccattatatggctttgatcctgaatcagactacagaacatatttgtggaaaatgattataggtaatattgtattgaatgaccagaagtttgttggtttgtatcaatacatatgggcttatccacgtataagagacagttcattaactgttcttaattcaaaatcccaagttttttatatgggtaacgtacctctaaatgtctttttacaagatacagtatatgtttcttcttaaggatctctagtatgagaaaatttttaataggtatgttttgtacatatcctgataataaagtcagttctactaaagtttggaatgctattggtatgattgttatgtccagtatgtttatttatttgggaattgataaagaaattcctgaatggatgggctgggcttttgtttttatgatcacaccatccagacttatgaagatcttaatagatttacgttggggcagatcacctgcccctgataaggaggataactaatggcagattatggtttaacagatgctggttttgtcattccaacgtttgatgattttttaaaatattatatgacagcattgaaaaatactttcggtgcagatacagctacatctgaagatactgtctttggtcaactgtttcgtattattgcatgtaccgattacaccctttgggaaggtatgcaaggtgtttacaatacccaaaccttagatggtgcagaaggtatttaccttgacgaaattttctctaaaaggggtttttatcgtaaggcggcttctgctggtagtggttatgcttatgttaaatctaacaataaggcagcttggacttatgaactaagcacagatgtttattttaatgccgataacgatttgacatattatgtcagtgcaccgacaatgttgaatgctaagattggagcatataccatttctaaagcaaacgcaacagcttctggtgaaacttctattactttctacattcaaagtgctattgatggtggtcttaacagtaaaacactaagtcctagtaatacgaactttattgtagatctcacgaatttcattaaagctaacgtatcaacaacagatcgtgctttagtatggaatgatgctagtaatgtttacatgggttataatccagaagataatgttaacccaataggtctagtaacaccagtgaaattttatgcatctattgcaattggtacaaaatggagtgaaattccagttacgtgttcagacgttggttataatccagtaggtacagaaagtattacaggtatttcttcaacgtttacaggctttttagatacaggtaacttctatccattctctccaggtacagatgttgaaacagatgcagaattccgttctcgtttcaatgataatatggatgaagctaatgctgctactcgtgctgctattgttaaagctctattactgacagatggtgtgacaaaggttaagatttatgataaccctacactacacgatcaggaacatgctccagctatgacattccagactattgtgtatggtggtacagcagaagaagttgcacaggttatttataatactaagcctattaacaccttaacctatggtacaacagcaattactatcataacagaagatggcggtcaagaagtaattcgtttttctcctggtgataatgcggaatactcgcttaaactggtgtatcaaactggtaatggtagtgtgttaagtacaacagaaagggaaaatattgtttctgctcttgcaaacttacaggcttattttgaattagggtcaacagtaactaacgatcagataaaaggtgtaatttattctgcacttgcgttcggacgcttgacttctctccgtgtttatgttaaacttaatactgaggatgacagtaaatataatgagggagatatcactccagcgtacaatgttgtaccatcctttgaccttgataatatttcctacgagtacggagtctaaaaatggcagtgagtgttgaccatgtgacaacgtgggatagtatcaatgaagatgttaaagacctactgattgaagattttaaatcttctccgaacattgtcaaactactctatatcatttctagcgaaaaacaaaagatagatcaggcaatgatctatcttgccaaacaccgcttaatctctactgcaactggtaagtatttagatcttattggtgaagaaatggggatggaaagaaatggtgctacagatgaagagtatcgtacaatattaaaaatcagggcttatcgtgttgcgtcttctggtacgcgagatgatatcattgatatgttcgctcgttttacaggaacagaaaaagaaacgattaatacatacgttggattaaataaaacattcgacgtattcttttataatttgtgtctacaatccgatcaggcagtagcacagttacttaacgttttcccgatactaagcagttatcgcttaggtgcgaaagcgggtgcagcctttggtttcacttcctattatgccactaagccacctcatggtataggtggtttaggttctctttacacagaggctgaaggagatgatacagggcgaatgactatgctgatagctcaaatagaataaggagttacccttaatggcaaagccacaatactaccctgactgggcgacacaaacagtaaccctcccaggaacgggaaacacaaacaagattagaccaaaagaaaccatccgtaatgttggtatggactttggtcagattatgacttgtgaagaaatgaactggatcttaaacaatattgggtcttggattcgctatatgcaagatgaattcttcccaacattgcctacgacatatcttcctatagtcggtactaaaattacaatggcaggtgatgctacaggtgaagttacatggaatggtaatgctgctgtaacattgtctattcaagtagtagataacagccataatcacttatcagctaacattacagacgcaacatcaaaccaagttgtagggaatgtccttgttaagcgtgataatggtggtgctatctatgcaggtgatatttacacttgtggtacaagtgctacagatcctgcaacattattttttagaaactataacggacaaacagtaggcaatatgtcttctgaaccaggtgcaggtggtcaactctatatttatagaataaatccatctactggaggaacatcttgtggagtccgtttgtatgatgcaggttatgttttaatagacaaccctcgttctaattctggtcaagatactggtaatggtaatgctcttgtaagattagattatcttaactcaagactaaactcattgcaaagcacactgcaaaataatattaacaacgttaatagcaacttgcaaggccaaattaataacattaacaatagagtttcttctgttgtgtctgctatccgtctaggagcacgtatccaagctggtgtgtctgagtctcgtttctatgctggtcacgtgatcacaggttggggctttggtgataagaaagaacttcgtggtgcttggtattggtcagccccgctacaatattatattaatggtagctggataacagtaaccaacgtttcataaggagagtctatgaaaaaagatgttatttttacaggttttgaattgtacgaaccggaattaacagaggaaaacattctttatctttctgttggcggtggttttttgcaagacaaggatggtaatgattggtatcaacttcaaaaacctttatggctgaattatcccgacgcttattttattaccttagatgataataatattgtacgtggtgctactaaagatgttactacctatttccctgccggacaatctattttagttacatataatgcaccagataaaatagaagatgaaagtaatattggctcttggcaatatgttgaaggtaaatttgttcctcacaatagtcttgctattgaagatgctactcttaagttagaaaaggagttaacttgggctacgaatcaagtgtctgcgattcaagatttagaggaattacaaggtttatctgaagaacaaaaagattggttaggaaaagttaaactctatcgtgcaacattaattcaaattaacgttgaagatgcacctaatataacttggcctacaagacctaagaaataggggtaatgtatggagctaacagaagtatgggatatcgctaaagaggcgattatccctcttattggcgtaatctgggtggtcttcaaacagaagatagatgatatggcaagtgatttggacaaaatggaagacaagtaccgcgaactagaaaagaagttggtgtttgttgaatccacttatgctaccaaagcagaacttgctcaaatgcttaaccagatcaactctacattaatggcaaataatactgccttagaacagaagattgaaaaaataatggatttaaaaaatgctcctgttcaattaatgctagaggagattacaaagcgcacacaaagtaaggacaaaaattaatggcgaattttccaacatatcctgctacgacactagaacaaggtgttgatctggttatattctcgtctaaccagatgcatgatgttattaatggggatgctacagcaactgtagaaaccgaaacaggtttaatacctacactgcgtaaagcacttgttgataacttcttctttaagagtcctgttgcttggtcagcaggatcaactgaaactgtatttaaccagttacgttattttgaaaacggtatcttgagtgggtactattatgctccatctgccactactgcgaaccctgtacctatgcagggtacacctgtaggagacagtaactggactctgtacgctcttaaaactgaacagttagcttcagatgtatatccttggtattttaaaggtgctacaggatatgaaacagaaatcagtcctccttatatctttgataatgctattgtcaccattaacggtgtaattcagattcaaggtgaagcatttactatcaaagatagtaaaattattctggcagaaccattaggtttagatccgtctactggtctacctaacaaattgtttgcttttattggtaaaacaacagcctctacttcttacgtagagaaaaaccttttgtcatctactactggtgcagcaatggttggtcttccatctggaggcaacctgttacaagctcaatactttgtaacgcctgagcagtttggtgcaattggtgatggagttaccgatgatactcaagcaattttaaaaaccattactttcgctaacacgaataacattcaagtacgtgcagataagaattatagattcacaagctcaattgctatgtctggtattcgttggtatggtggtacattcactggtaacggtggaacaatgatttctactgtgtcctgctggattgaaaacgttcgctttgaaaaatgttatgttaagatgttaggtggggattgccgattctatcgtaatattttctccaacgcaacatctacagcagcattcttaatgcaagcaatgacaagtgaaggtacgttggacttcagttacaacgaaatgtatggttgtaaatatgcgatcctgcaacaaggtactggagaagtaatgacctatgggcgttactctaacaactatattcacgatatcaaaggtgatgctattgaacttaacgtagttcaaaaacactacactgaaggtttgattatcgagaataaccacattgctaacgtagatgcttctggacaaggtgcaaactggggtattggtattggtgtagcaggtagtggcccatatggtgttgatgctcctgattcacaatatgtacgtaatttcagtatcattgggaatagggtttacaattgccgtcaatgtttacacgttgaaatgggtaaaaacttcacaatacgtgataatgaagtttatcctaacacagcagtttcaacaggtacaggtttaactacttgtggtgttgcattatacggatgccaagactttgaagttgatggtttaactggttatctgcttaatgatccgtctgtttcaacacgcatggtctttattgactggggtgttaacagtggaagatatgcggggccaccaattaactttacaattaagaatttggatattccagaatcttcaattgagattgcaacggctggatcagatgcctgggaaaactctacaattgttagtaacatcaattgtaatgtttttaaatggcgtggactaccatctagctctacctttaataacattcgttgccgtagtattgactttattggtcaacatggaagcggagaaggaagtggtggcggtttctatactcgcagccaattcacgtatatgaagtgggtaggatgtacagcacttagcggagatgaaacaacagtttcttttgctaaaatctacactgatcgttgcgatcaggttggaaataactttggtgttccaactgctgttgatggtacaggtcatcgtgggccagttttaactactatttctgaacaatattttacagcttatgatgaattcccaggtgggcgtgaattccctactggaacagttattcattgtgcaagcggtaaaaaacatgttgttacagtaggtggtgctttctttagtgccaacgagaaaataaaagcaactgttacaggtcaaacctatctacagtctaatgctttaaactgggctagtaatggctacgctaaagcagcaggtactaagattgttattccaggtgcaggtgcaaatggcggcgatcttgtgacaactatagcacgtgctacatatgtgacaaatagtttgtacacaatagatattgcagatccaattgtaacacctacagcagagaatacacaaattaaagctctgaaccctgttacttttgttactgtcaacaatgcttaattaaaaaggggcgaaagcccctttataaaaggagtagtaaagtgattttaacacgtccaaatagtgccattgcagacatggtagagtctcgctatagaaagcgtagaagttttgcaagtggttttaccttaagagatgctcgtgaagcattgctctttgaaactgacggtaactactatcagtggaaaggttctctacctaaagttgtacctgctaactctactcctacatctactggagggatttcagatacagcttggaaaaatgtgggtaatgcagatgacattgctcaaatagaatcagaattagatgctattgaagctgaaattgaagatcttagagaatccattccagaagctggtaaatcagcttaccagattgccgtagacaatggtttccaaggcactgagacagactggttggcttctttaaaaggtgatccaggtgctccattaaagctgctagggacgctatctaataccaaccaattacctacaactggaaacaatgcaggagatgcatggattgtaggcgagaatatgtatgcttgggatggtactgcttggagaaaagtaaactcacaggggccagaaggtaaatcagcttatcaagtttggcttgcagcaggaaaccaaggtacagaactagattatcttgcttcaattaaaggtgataaaggggagcctggcccagaggggccacaaggtgtgccaggtaacaatgctaatggttttgattaccaaggtgcagctaattccgtttcagatcttccttctgcatctcctggaaacacatctcaagcatggagtattggtacatatctatacgtgtcaaacggtgtagaatggatcaatatgggcgctatagtggggccaaaaggagataaaggcgacaaaggagataagggtaacactggtgattcagcttatcaagtctggttaaacgctggtaacgttggtactattgacgaatatattgcctctctgaaaggagaaaaaggtgataagggagacaagggtgatcaaggtgagcagggtatacaaggcttgacggggccaactggtgcagggttgaccattattgatattctgactgacacttctgaactaccacaaactggagaagatggtgatggttatctgatcaataatgaactttgggtttggttgcaaggagccacacagtggacaaatgttggtcgtttagctggtactccaatcactgcaaaaggacacgttgcatctgcaagtgcacttcctcctacatccaattacggtgatgcttatctgacggaagatacaggtcatctttacatttacacctatgatgaacaaactcaaactgctgaatatgtagatatgggtagtttgaaaggtgataagggtgagaaaggtgacgctggtactaacggtacagacggtgcaacttggattgttaaaacaacagatccaatctctagtgatggtaaacaaggggattatgcctttaatatctccactggcgaggtgttcttaaaaacatctgcaactgtctggacttctcaaggtacactacctagcattacagatgcacctagtgatggtaaaatttatgctcgtaaagatggagcatgggaagaactcactagttctgtagatggtcaagatatagttccaacaaaagtaacaactaattttatagaggttacagcatataccaacgattctgttacaggggactggacacctccaggaacacataacatgaatgtgttgaatcttactggtaactctactataaaagcatggcctggtgtcgaagatagtacaaaacctaaaccattctctgcaatagtttatcttatccaagatgccactggaggtcgtactgttactttagatccatcttataaagtaattggttctagtgatattaatacagatcctaacggagtaacaatactacaactaacatattgtggtgttggcgattacgtggatgctattgttgctaaacgcacataatcaaagccccttcgggggcttattatttaaggagattaaatgtatcctattcctttatttatgtcaacaacatcagcttcaggagtaacagctacatctataaccactgcctctattggtattgcaatagttggtagtaaaaaacaactgacatacacagttacaccggaagatggtgcgttatttgatatagctttttcatcttcagataataccaaaatggttatagataatagtggtatgatggagtttgttgccgaaggtggttttgatgcaataatgacagctaaaaataatttaggtgctgtcttaactgatcaatctggtggttatgcttcagaattaagcgtgtacactgaaagtctatctgctatggatgtaggcactactcaacagttggttgctacaatcagtccagaaggtgctaaagaccttccagatatggtaattacatacaccacaacagatccagaagtagctactgtaagccctacaggattaataactgctcttaaagatggcaattgccgtataggttgtactgcaacgtatcaaggaacagttgtggcctctgatagttcttatttaggtgttaatgctattcctgttatttctaatgtaacagccgtggcaaacagctatggagacgttcgtgttgcttgggatgtaactgatccgctagatggtgatacttatactgtagaagtattagatttaagtaataatagtgttcagtggactacaacaaccacgaatactcatgcttactttgatatctctgactctattcctctttatgggtttgctccaacataccttaaaattagcgttaagagcaccaaagcagcacctgttatctttaataactcaatagctacagatgattcgttcattaaagaagttattgtctttgctggacaagataacgtaaatgcgcactttacagaattgtctggtgcaaataaagcagcaatgagtagcacaacagcccgtaatgcatatgctacgcaacgtggtttagcaaatgctgaagttcttccgttaaatacagcttctggatcatcagcagcagataaatatgctgacgataaagccggaacaggtacaccagacaactactggtatgatctggataacacagcagatgggccatgcttaactaattttatcactaaagtcacaccttatgcaagtaaggttaaagcaattatttggggacaaggtgaaaatgatgctgtatcagcatcttcaactgttgcaggtagatacagtaacactacacgttaccatgatgctacgatagctatctttgataagatgcgtacaatagttcctgcttctcaagcaaaaattgtttggcagattctaggacgttcttatttatatggtgtagaagttaatggtgtggattggcagaaatacagaaatgtacaaagagccatctctacggcacgtgatgatgttatcattggttcttgggtagatggtgctgaacgttacagtggttatgtttatgaagaaggtattgatggtcgtatccattatatttcttctgtataccagacagcagctacaaaacttgctaaatcagcagcagacggtacagacctaacatcaacgtcacctgtttgggttgatatggctgttccaactggagcaacagctacttcccaatctaatcaagatacaattttagcatgggatgctcaaggctatagcaaacactacttccgtaatattaacgtcttaacagcatctgtattaactgaacaaacgcttaatacgaacagttatacgtttacctatgcagatcaagtagaacaatatggttttgcagcaggaactactgtatttgatgttgcatattatgatgaagcaaatgatgtgttatctcctttagtacgttttaatgttaacgttacaccaggaaccgtagaagataaacctgtcgtgatggactatgatttgacgcaagaaactcttccagcagatgtgcgcgtaaacaggagcaaccattatgctagggcttctggagatatccttgtaccgacagaggtttctgctcctgtagcacctttagaatatattggtacaacgccacaaggtagacgtgttgtagcagccaaccgtacatatatctttgtcaacaataacttgacaacagcttccccgtggttgaagacgaacttgacagttacagcatcaacaatcaactctccggttggaactacagctaacacttacaagttaacaccttctacaacttcaggacaacatattttatcagcagtgaatacagcttctgatattacagcaggtaggcaatgggctgcatctgtattcttgaagccagacgggatcactaaagtgaagctcaaattgacttcaggaaatgaggttaacgaagggacttatgatcttgaagctggaacatttacaggcacagatgcaaatatgatcgacatggggaatggttggtatcgtgtaatcttacataaagtaacggttgctaaacaagcctctatgacttatgagattatagctttgaatgccagtggatcagacacttttgcaggagatggcactggaggtcttattgcttgggttccacaacttgaaatgggcgatatgacaaacccagtttgggcggggacaccatttgtttgtacttatgcacgagacacagatagtgctgccaccttcactattcctaagaacggacacactggcgtggatatttaccacacagatggaactgtgcaaagagagattttcactggcacagctactacttggatgttatcattcaacgccgcaagtgcagattggggatcgaaattcatctctggtttgaaatattacgactaataaaaaaggagccattaggctccttttcttttatcttaatcagtgaaaattacgcttacatcttctttagaaaagagtttatgatcttcaccttttgtctcaagagtttcatacaggttaagaagttctgaaacatctttctctaccagtttcttcaatgttgcaattttctgtttgcgactcttaatacgttcagctacaaccttacgctggtatccggcagtacgataacctgagaaagttacaccagtgagacttgcagttacaggatcgtaatgacgttcaatttgaaatttattaaaaggtacagcatcatcacgaataatcttaccgccattacttacttgacgaagaccagtaacttgctccagtcgtgccatagaaatctttggagacagaccagagtccaggttcataccattgttaatcagtgctttcagggtgattttgctgttctgtgtactcatttagtcgttcctccgcttgcttaaaaatatttacatcggcttcacagcctaagtattctctacctgttaaaagtgccgcaacttgtgttgttgcacttccagagaagaagtctaagactacatctccttcgttggtatgtatattaataaggtcacaaaacaaagtcaagtgtttttgtgttggatgaaaacgatctgctccttgatagataggatactcaaacacacccttatggtaggaagcattgaaggttggcttcgaacctttaacacaaacaatagccatctctttagcgttactaaggtagttaacaccactgttgatgggtacagggtttgttttaatccattcgatagtacggaacatacgaaaaccaagtggttcaaggatttcacgtagctcttggatcttccagatatcataccaaacgatgcaagtaccaccttttctaagcaccctgtaggcttctttgaatacttctttaaagtaaggaatatctacaacatcccaatcaccaaagttgtaagatacacggaatctatccgtatcttttccagtaggctctccagattgaaaatttgtatcacgagaaatagcatatggtgggtcagtaagaatcaaatctacactgttgctttcgagggtttgcaggtagtttaatgcggtgttgtttacaaattcgctcattatatctccttcaaagaaaaggagccgttaggctccttatattgacacaatatttaactattagaaacagtgcaggaagtttcgaccatactgcaaaccaataggagcaaatgggatatcatcatcgaaatcttgaacaacaggttctggctctttcggtgctggctctttcttctctacttttttagtttctttcttaacttcttgtactggggtagacattccacggatagcagcagctactttatcagacaaagcaagaacttcacgagcagcttcaataatctcttctgccgttacagttttacctgtatgatcacgacaagcgttaagaattgcgtgtccaactgaagcaccaagatcataatcagtcacatcaacgccacgatctttagcaatttcagctttcagagtaacagttgcagattgtaccacaccagccaagtcgaaagcatcacctttcacaccagcacgtagaagctccagagcgccgtttacagcgtgtcctgtttcaatccctacggtatcacgttttttgtagttaggcttgctaccgtcattattagatggcttatttccaccttttgaagaagattgtgcttgctgaacaccttctgttgaaagaatagtgattttacctttagaggaattgtagtatgttttgccattccattcggaaggtttaacatccatagttagttctacacctttttcgatagtaacccacttatcaccatctttaacttgcaggttttcatgttctgggtgcagtttaacttcacctaggctaacccaaacacctttatcatcagcaccagcacctttctctttaataagcagagatgctttgtgagttgattcaattttcttatctggctgacctgcaaccttaatataagagactttcatttcatcaaacttatctagtttgacatattcgacaataccttcagcccagaatgcttcttttttagtacggcggtcgatttcagaattaattactggcataaattctcctctataattacattactttaacacaaaactctcgtaaaagagtagcgtcagtttcttccaacaggtatttaccaagaccaataccaaagcctatttcaccactttcaaaatggagaatttgtatcttttctccaccaagattaattacttttgcttttccaggattatccaaaacatctcgtattgtatcctgtagtaacataagctcacgttttgtgatagtggtttcagatatctctttgttttctactctcactgttaaacgattgtatccaccaaagagacatagtatttgaataaaaaaggtattatcttgaggttcaacatcttttttggttagctcaagacgattagtttctctactgtagaacgtctcgactaagattttagaacgattatctgtcattcaagtcctcataataacacataattataatgtttgtcaacacttaaattttaaattcttcattgttaaatgaatccagtgtacgtacttctggttctttgggaatgaaaacgtcttttacaaaacggaacatagggaaacgttctgccattttacggacgtgtgcttctttacctgtgtatcggtgattaatagtgcaaatattagtcttcaatgcaaattcaaaatctggatgatatacatagttttgaccatcccagtaacacaggcagatagctacatcaaagttccatacgatttcactgcgtacaccttcttccatgatcataaagttaaacttaaggtctttatagtatgcttcaaatacccatttcaaatgtggtagttcggcataagtgtgttctgtttgcttagtaagttgtttcacattacgtgcaccaacacccaacatcaaaaatttctctactagtacgagtgtattgtggttaggcatacgcaagtaaatgtcaatatcttgcgcaggtttctctaatcgccaatcacgtacagcgccgccagctacaattgcaaacggatctaccaattggcacatacgtaatacttctaaagcgcgtactttttgatcttcaatattcatattttctcctatctcttatggtctttgcattattctagatgttcaaacatctaattatgaaatggtttaaaagtgcggaacaaccttggcaatcacagcatataccataaaaaactcctttaaaacaaaattttaggccaatgacaactggcccatgagttaccaacatcgtaaccagcagttagaggtacattaagattgtaatactcaccagctttattaacagcgatagatgctaattctccagcacgactgtaggctgtaaaccaaccaccttttggagactcatgtacgttagcccaaatcttgccagtacgtttctcttcctcttctttccaggcattaactttatccaaacattctttatcaattttcttttgttcatctggatcatcaacttgagtccaacctaaagattctttagagaaccatttaaaatgcaccagatcacgagttacttcaagctgtgcttcatcgtgatatgcaatcatttgttgaacgaatgacttatttttccagtcatcaacaaaaaagtcaacagctaatccttcttcttcgataagatcatcgtagataaccattgctctttttgcacaaataacaccaccactctggaatagagagttaagtattgcgtgtgcagatcgtgtaggtactttcctaccatcaataccaagaatgtatttcttacctgttttaacccaaaaatcatgcagacgttctttaagaagagcaagaggttttgcagcttcccagaaaggattcttatacaagctgtcctgtatacatatcactaccaatggtttttgctacttttgcagcttgagcaccataagtaataccatacttaacagatttagcagggcttcgttcaaacttacgaccaatagtatcagaaatacgtcgagccatcattgtatgaacatcattaggtttttccaacaacagagcattacaatattcgtgtggttcctgctcgtaccgccaacagtagtgtgattctatttttgcctcaagagaatcaaagtcataaccaatttggaagtattttggaacttctacaccaaataagttacgcatttcatatccgtacagagatgttacacgtgggatatttgctactaacctatgtttcatacgagacgtagctgcgtcacacgttgcagcaggggttggtatacgaccatcagcccttactgctgccagataacctttatcgtaatcctcttcttcttcccaatcagcaccaccccctagaatagagttcctacggtgtttatacgtaagatactgcacaatctgcgtagcataaggaaacttttcacctagtgcttccaagttaggacaaatatccttctcttgcccttttgtaaaggaagggttagtaagcactttaacaccacgacctttagctttagcaatacgatctcttaatttccattccaaagtttctggtgtgcactccagatgatcacatctgtcctggcagaagttagatgctaatgtttgatcaacatagtcacgaatagctttctccatttgtgcttcatctttcttaatcttagtgccagatttaagagtgatatctttatctttatattcagatggactccaacctaaaccaaccaaccaatttttaatatgtgtcgtgtcgtctaaagtagcaggtactgtaggatcacaaataggttcttctgctggaatagggagtttaaactctttacctaatgcaaataaccaccaaccatcttctttttgtacaagttcaccagaatgtttctctgcaaactttatcatgttacttgaaggttcaccattctttttaaactgtagtttaggtggaatgaatgatttcaaataacctttagtagcaggtttaggaggtagtacaggttctgcctctaaacgacatgcttccattcgagcatccagatcacgaatattatcttctgcttgtttcatattgaaagcaaagccacggtgctcttgacgtgtaataatatcagctacacgttgttctaagttaaatggttcagaccacttactataatcaccccactcttccatcaaataacggaacactgcggtgttagctttgttatcgtaaatacagtaatacagcatgtctgctgcaaatgttctaaatctttcagtttcaggaatgttttttctgaagtcaattttaacatcccctccagctttcttagataactctgccagactatgaccaccgaagcgatcagggtttagtgtcttacttaagatcatagtatcacaaatttcaatgttactattaccccaagtattgtacttaacactgtagttgagtttaaaaaataatttaattgccagtaagtcgaagttaatgatgttgtgtccaactactttggtaattttatagtttgaattacctttaaatttacctgttccatttacaaaatcaggaaaatctttaagagggaaatgggtatattctaaatgctcatattcctccagtcggtattcatactttccgtcagtctcaacatacggacgaccatcgaaaagatatttatcaccatcatggaaagcaataatctctccagtatcatgactttcgcacacaatacagtgcattgcaaaactatcttttaaacgatatggacttgccaagtaatctacactttcgtcattaagcaagttgttactttcaatgtcgaaagtaaaagctcccattctccctccttaaaatatttctaaagtcttaatttgttaatactgtaccataaattaattgttttgtaaaggggctttcgccccttcttgttatttattgtcagcacttaattgtactttaataaggcaattagggacaccattggtatttctcaagcctacacggtcaattttaactgtccctgttaagccactaaaagtggaaacaatgttattaatgttttcatccttactagtgatatcaagaacaactttatcactaacatttttcaacatacgatctacaagctctcccacaaaaccactggtagtttgaatgagaaggtatagacaaccatcctcaaaccacaaatgttcaccataagcataaccgtatggttctaattccgatccgtcttggaatttaaacttagcaatagttttcgtataatcatacgctaaagcagaagggcataccccatagaggatgttttcgttgtctttcatattttctccttaataagaaccagcaggaatattctctgggttacttgtgtattgatcgtaatcgtgaagtgttgctgttttaatctcatagaagaaactacctgctgcaccagtctctgagaactcacggttctttagaatgtagcaatatgtgcggttacgttccataggatcttcagcttgtttatcacgctccagcgcaattgtgataccagcacctttagcaaggaagctactacccattgcatcatcttctacaatatgctcattactattgttagaagattttttaacgtgtgaaattacaacaatggtgattgcgtactctttcataatgcgtttgagccacgtcgcaagttcctcttgttgtgacacgtccataccagaaagcaaatcagaataagggtcgataacaagaatggttactccgaaataaataatcatttccagaaccttctctttaatcacatctacgttagctccacggtcatcacaaacatagaaacgtggtgttccatcttcccgttcgtaaaaatcacgaatcttttcttcattatcttttaaaatcttttccttctcttctttcgttttacggtgaagagggatatgcaagaatgaagacagtaagttacgagaatacttcttatacgttgcctccaaagataaaataccaagagtatgttctgggtgtgcaagaataatgtgcttcgtaatctcgttaaccaacagtgtcttaccgatacttgtttttgcaagtataacagtaatttcttcttctaccaagcctccacctaacatattagaagcaacacgcatgaatggaggaagtgtgatcattttagcttccaggcattccaaggctgcttcgtacagtacgttagaagcataaacaccagcaggtgtgtacagtttagctttgaaaaagcgatcaataaagtgatcaatttttccttctactaatgcctggttaggatctttaacatccgttagttccatcacgtaaactttattacgtggtaagattttaacacatttctcaactgctgcgcgtccagcttcatcattatccatacacagaacaatctttttaaattgatctaagaatttataacgatgttgaagctgcttgtgcagagatgtttcgccacaagtaccagatactacagcaggaacaggatatttaccacccttgttataatcttttagcatctgtgttgcagccagcatatcgtgttcaccaccaacgattagaatagtaccgctgtggttacgatatttaaactccccaaaaagatcacaatcctttcctgtttcaccgataggatgcgaaaaatcttttggatcgatacgttgtttatacccggcaatattgtaatctttagttgtagggtatagtgttgaaattacttcgccagtggcttcatcgtacatatagcgtacaccgaaaggcttagagatatcctcacgaataccgcgataaccttttggattagttccagtgctggcttttagtttatcatgcacttctggattaaactcactacccaagatatcctcctcttcaatttcttcgccgtgtgcatttaaccatttttgatcagggatagtaaagccacaagaaaaacaatgtgcgcctcgatggtcttcatcggcatctaagccatataccattaaattgttttgtgatcgatcacgtcctcctttcatacaacgaggacacccagtatgtccttcttgacttagatcaatgttatacccatatttatttacaacataagacacatgattctcctactaaaatgattcgtttgtctccataatatattgcatttccaaatcttccatatgtttcttaaattggtaaacaatttccgatggggaaatatctatatcaaaaagttcttttgtaccagaataaaacctaataccatcaacaataagaccaccataataatcccaatcactttctcgtgagaaaggattaggttcttcataatagtaatctacttcaacaataataggttctttattatcttgtttatactcaaaatcaaaagtgttcattataaatcctcgataagcagtctgcgggtttcatttaaatcatcaatattgtagttatctcttacatacttagcaagagctaatcctttctcaatacaaacatcaggagattcgattaagtattctacaatatctttccactctttaactgaatcagcaaagaagattagatctttaaattcttcagtataatagttctcccgtggtgaacaaacgagtggcaaacctttagcaccagcttcaagaatttttaaattacttttggcattattaaaatgattatttactaacggagctatggagatttgatgaccatcgtatgcttccatataacactcataaggacgaataccttcataaacacaatctggttgaatatcttctttaatttgcaaccattgagcactacttaactcttcgtgatctctacgaaatccacataaagttaaatctttaccaaaactaggaagaatagctagatcatgtttatgtgtttcacttcccgcccaaaccagtggacttttagaataacgatctttcgtaagaacaaactgtccttcatcaaaaggtagtccgttaggcacaatatgtacattatcgttgtattggcttaattcaacctttaatgctggagttgttgtagttacaagatcgcttctttcaaggaaccattttagatcatctcggatttgattttcaaataatccttcaagcatatgtccttcaggaataattaaagaatcatccagatccattaccaatttaaacccaagttgtttaagagccaggaaacctggctttccacgggttggtactccattgaacacaaaaatattatgcttaggattgatggtcagtttgcgtttatatggcaaaatgattctatgaaaatcacatacactatacttttcatttccgcgtgtgtcaagaataatattaggcatatcgctccttattaaagactttcaataacttgacgacgcagttcattggcatctgcaagattataattaagacgaacgtgttctgcaagcatcataccacgatcttctgtgtatctagggtttctcattagcttgacaacttcataatgccaagatgctttagagtctgcatagataacagcctttgcatctaccggattgaagtacggcagcacaggagaacagataataggaagaccctttgcacctgcttccaaaatcttcaaattgcttttacagttgttgaagtcattatctaccagaggagcaattgcaatactgtgaccgtcatacacagacatatactcacctaaatttttaatagcaggtttatactgtgcatttggaattttacgttttactttaacccactccgcagtagttagatactgactattatttccaacaggtgcagaaggatacacttcataccctgcaattgtcaatagtgtatcatcaaatgtattagctacaagagataaatcaggttcatggcttgctcctccagcccaaataataggcgtgtcagaataacggtcttttgtcaaagtaaattgaccttcgtcgtaaggtagtgcgtttctaataacgacaacattacgatttaaatgacgaattttgtaagctaggtattctgttgttactgtaacaacatctgctaacttaaccatctctacaatagtctttgaatgattagtaaatacgccagccatataatgttcaggattaagtgaataaaagtcatctaaatcaacaataatcttaacaccttgtgccttcaggcgtttaacttcgtctgctccatgagaatacactctattaaaaactaaaacgtctttcttaggtttaaacgtatttccagcaaatggcattacaatacgatggtaatcacaaccactgcctaacttattatcacacttaagtacaggagtattaggatttaccatatttttgagcctcctcataagagataaaagttttaccattgcgaagatcctccagtgattgtttatattgttcccagtttacaccaatcccctgttctttctcttcttttgacagattcgcaaaaggtaaaggattgtctccaaacacatcgtcaggatggataaacgccataattcgaataggacatggtacgccgtgaatacctcggttcaaacctgccagtggaacgcgctgaatccactctgcatcttcatatccataaccgtgggtgtatgagcggaaatagccagctttctcaataactgcacgggagtacataccaaactggcacatacctagctcccaaataaccacttccccttcaatgccttttactttatctttaaagtattcaggcataccaaagaaatcccaaccattttccttcgcctgttttacaaaatatgtttcccaacctggaacaacaggatagcaatcatcatcaaaaataaaccagtagtcatacccttcgtcataaaactttttcatcagttcattacgagcatatgcaacaccttttcgttcccgatcatactgtacaacaaaagtagcattaggatcagtcacaagataatctttaagaggacgcttacctacagtaataacaccaacaccaatttttgtattttccaaaataactccttaaataattttattcatgtcttgacaatgtaaaaggtgtgaaacagcttttctaggatcatcattacctaaacggtaggtgtgaaataaatataacccacgtagtaaacctagccttttattattagcatgtaatgctttagagaaaattatatcaaactgtattgatctttcttcaaaagggatttcattccacagactcttacgaaagagaagaaagaatcctgctaagatagcatctgtaggtacttcctctattgagtttccccattctagatgtgctctttttgcaatctcaatgtggtgtaatatatttggatcttcacttctttcattattaactaattgatatgttgatcccaatctattacaagatgcaccaagaacatcaaaatcaggatttgaacggactattgattccaaccaagcaggttgttctggaagaagaaacattgtatcaatgtctcttaggcaaatccaactatcttctggtaagacacttattgtgtcattgataccttttccaatatctccagaaagatagggagttatgtgaaatatcatactccctccgtattattactttagcatttttagactaaaaagtccaaatggttttacctattgattacgttttgcgagttccatttggatagctaaactgtgatctcgtgcttccatatactctttatatgtttcattaagatgatcacgacaaacatcacgcagtttaatcagtttatctgtagggataccactaagatcatcccaagattttacaacttcaccagtatcattgatcccaatggttttcatctacaacctccttaattgctacagcacagtttttgcagatacactgccctttacctttagaaatctggatgtaaggttcattttcattttcgcccttacgtgagtcatatattacagaattgaagcacacaacgcaaatattttttaagattgtatacttatcaactttcttttttgttttaaagttaacttcaataacatcagccatcagtgtaacactcccagtatgttgttttgtgacataaccatagaacattcaacattatcgtgactacgtgaaaaacgttcccaaacatcttcatcgactcgtaaagctatacaaggatagacgttatcattgatcatttcaattgaataaacatccacattgtcttcgtcttcgatgaacatcattgcaaactgttctaaatgtttcctaatgtaatgtacatcctcttctgtaagaccaataacaagataacttgcaacgataacgccatctttcatctatatctccttagcgatagaattgatgttctttgtagcggtacactagaaccatatctttctcccagtgtgctcttattgtagattttttaaagtataatgctccttttgtaatatctaatgcaattcgtaattctggaaaatggttatcgagataaagtagacgttctgctatagccttagcttccttccacttatcgtgttccataacgttgaatgtcttcgtgtaagagaattgtcctttttgaaacaaaacttcttttatagtattagggaaatatgaatctctcgccctatttaatactacattaccaacagcagacataccgcgctttccttgattacgactttctgcatagattgcacaagctaatagattttctttactatcacgctttgtacacttgtgaactactttagcagtttttacgtttgcagcttcggcttgcgccacaacaggtgtaaatgtaaaagcagttaaggatagtaacgcaattgcgacaaaggtttttattgacaaacttgcctcctattttgttaaacgaacttttattgtaacacagaagaggctgttttgcaagtggagggggataatccccctcttagactctgttagatattgtaaacctttgtatgagttactacaccatcttctacaaaatcaatacgttcttgatccgtgactagtgcagacaacactttaaatttaatttttacacgttcaaaagctggttgaccatctttaagataattatgttcagttgtcactgtcttgtttacaaaatcaacttttgctttaccgttttcgcgtaggtggaatgtttttcctgctttgtacacaatttcaacattaccttcgagagtaattccttcaaaaagttcaccctcttcttcattttcttcatttttgaacagacgacgaaactcttccatatcaagataaacaacatcttcagaataactatcagtaaggtatgtcttaccatccattaacccgaaatattgccagatcgcagaataaacatcactagttgatccaagggtttctctgagtttagttccatggattacctcataaacttcaaaactgaaaccagactgcaaagcattaaacagtacatcactaacttctaaagcataatcttcattgttgtcaatatccacaagaaaattgccgctacgaataagtttttgaccttctaaagtaatacccattgttttctcctcttctatttaaaatatgcgccccgaagggcgctatgatttattactcgaaccaatcgtcgccagcgccaaacgctttaactacatcgtaaatgtcaagcccagctttacctacaccatatgctttcagtttccattcactatcttcccgtaccagggaggcaacgtggcaaatggtgttacctgcaagttctggagccaagaaatcaaagtccagcagttcaacattacgttcatcatcgaagattttaaggaaaccttcggtagcgtgaccaaggcgtttcttacccgtttcgtcatcaatagtaattacgaatgcaatttcctgtgcttcagcagagatattatccagagtaacatcaatctgctccatctgtcctacaccatcacgaacatcttcacctgcaaaagtagaacgttcaggatcaaatttctgcgcgtagcacaccaggtgacgaggagacaacagttccggcagaccagatgcattgtgtcggcaaatcagagcactaacatccagatccagtttttcgttagatttccaagagaattccagacgaatgcgtttcagtgctggtgcgatctttttcagagaaactttttcgctagaaccttttttcagggaaattttctgagtcataatttattatctcctttgttgttaatttacgttgtctattttactaatcttttctacaaagtcaagcgttttttacgcttttgctccgaattttttaacccactcgccaaactcttcggataacagtttatcgtagagttcttcatcagacaaggacaaatctgcaataccgataaaatcaacattatcgtattcttttgccaagtctttcaggaatttaaagtttgcattacctacaccaaccataaaccagtaaacaggcgtattgcggtgtttgttcagtaagctacgtactgctgaagtatccatgttctccccgtcagtttggaagaaaatcattgcaggagtacgatcaacttgtgcatcagtatctacaacctgttctacaacagtacgtgtaacttctacaagttcttttttaccagttagtttagcaaggaaacccttagccggaacttcttcatactcaacgacttcgcgtgtaatatttttcataggtacactaccgaagtatgtatcatagatctcttgcattacgggagcataagcagtaccaccgttgatgcaaacattagacatgcaagagccgacataatcatcatacacatcagccgttgcaggaggcagttcaaaagaagaactattgaaagcccacatgtcaatctgtgcattatcatcaaacttcataccaaacggcagcagtttacctacaaaatcactaacagtgccatcacgatacagctcacacatactacccgaaatatctaaggcgctacctacacgaagaacaacatcgttaatctttttcttacgcagagatacagtaagagtttcttgacgttttttaagactgattttattggacatattatttctcctttctgactgtaatgttagtgacttctaaatccacttctaccacttctgtatcatataaaatacagttaagttgacctctttgtgaaccgttcagacacattgcttggtttgtattaaccttaataaacaccaagtttctgaacgtatctaaaccagcatcttgataggcaacataatatacgaatgtatcacctgtgtcaagttctccaaaacatttaggttcatctgatttgtcgtctttgatattaaatttaagcactgtcttctcctttacctgctctcaagcctaaatagaaagcctctctggtgatcttttgcaactcgtttaaagagatagttacaactaaatcatcttcaatttctagctttgagtcttcttctgtctcaatgcaagtattatgcactttgtggtaaggattgtcaacacgtttaaatttattattttcagtgctgaagaagcaatctggatcttcttctccatcaccccagccctggttagggtcttcttcagatctttctattgggatctcacctgtaaagtgctcttctaacaccatagcaataccatccccaagatcggaagagaacatcaaattacaaacttcttcccaaggcatagaccacttgaatcttttacgattgccatgtttatcttcttcgttagagaaaacactaccatagctatcataattgccatacatctcttcaacaactttaccacctttcaaaagaaataggtagcaaggagagccatcgaaagaggtagaaagagcagcattaccagactctttgcataagaaactaaagcaccccattatacaccagccttaagatcaattatagccaaagttgtttcagagtgtgtttgctcgtctacaggtgcagtcatatgataatacaaaaaatcttcggcatcataccaatctgactcttgaccttgtttccaaccatcaatgaaagcatcttccataatggtttgtaactcttcacgagttaagtgaatatctttactcattacacattctcctcttttaccaattccatcgttgaactatcaaaaccatctttagaagaataggtatagacagaacgtagttctcgcagaacagtgaatacattaggatcatctaaccaagcatcctggaggagaacataacgatcttcattgtcgtactggacagcaatcatagaaccagacagtttgtaaattttaatattcataatatatttctccttaaagtagaccacgtttaacagtttgaatcataccatcttcaagagattgtacttcttggatgtaatcaatacgagcagcacgggcttcagtgttgattcggttagtttcttccaacattttaactaagttttcttgatcgcgacgtaatgtttcaatatccaatacttgacgattagcaagttttgtagcttcaatttggttttgtgcagccagatcactacccattgcaatagcagcattaaattcattcagtacattgttctgtgtatctgctgctttcttctggcgtagactttcaatatacatagaaaagtttgcagagtaagcagggataacattattcacaatattacgggctgatcgcatcaaacttgcagagactttctgcatactttgtacacgtggccccatctgaacacagagtaaacgtaaggctttcaggtctgcaatacgaatttcaagcagatccatagtatcacgagtacgttgacgctcttctacttcattttcaggtagtgtattaaggcgaacttcttctttttcataagtagctgctagaagctctatatccctgtttaagctaagagcatattttgcaatagcctcctctaaacgttgcagatatcgtaaagaatcttcttcttttttcaagtctgtttggagtgtctttaccaaaccttcaatacgattattgatggtgtcaaattctccaaacaaatcttctttcatacctaatactttcttaactaacttacctaaacctttagattgtttaatagaattaggatcaagttgctttgcttgcttaataagtgcagttaaacgttcactcatttcatctccctgagatgaacgctggtgtttaagcacttcagcattaaggttacgaagagtaagtcctgcatcagcaccaacttgttcaatctcttcacgagacattggaggcagcatttgtacaggtcgtgcaacagcaggggcatatacagggcttgcatccatagcacttggagcaaacaaagacttacttttttctgttgttgccgtgaatacactcatttcagacggtttgctttttacggcactgataaaaggactggacattcaatttcctccatattctttagtagatggtgatacctctgtaccaccatcataacacaaattaagtattaaacaaacatatctaaataatttgtagtaataaatgctccatctgcttccagattaacataaccagtagcattagtggttaagaaatccagatcgaaagactctttaacaccccgtacctcaacacgagagatatcgaatacaggtagtgtaacagcctcttcgtgcaataccgtacctttgtaggttgccttaatgataaacttgatattacccgttccagcatcatacaaaacactttcaaaccctttgagagtatacttatcaccagaagtgaagtgcaaagttgctttgtttacagtacgttttttacgaggagttcctttcacacgtttatgatcactacgttttttgtatttaggaatgaatacaaacgatacactctcaagaaaggtatcaacatcaaggattttaatatcctctgttgcagcaaattttgaagtcgttgcatcaaaatgcttttccctgcgatcatacataaagatatcaaaccgatcttctaaatcaaacaaattatgtatcttaatttcagaatgcttgcacattgcagcaaccttaaactcttcaaaacgtgggtgttctaccagttcttcaagttttacaccaaagacagtatatggtttcgaagttttttctggtgttggcattacagaagcataatcaccgattgcgctcttaaagcaaaattgttcttgacctgtatttttaccaacgaatttacagtattcgtcatcgtgcatgctttccttggtagtaccaacaaactcaaaaccatctttattcttctcaagaatttcttgattaaagatccaaccttccaggcgatacactttaccaacttctagtttcatctgtttctccttcttatttaatctgtattaaattattaacgacgacgtgagctactaaaactacgtttcgacgaagaataacttttcgaagacttactataagagctaataggacttgagtaagacttacgagcagagtaatcactattcacttttgttgttgatgggcgtgaatacgtttgtacactttgctgcttaattgtgttttgtttagtggttgtatatgtatttacaggtttatcataaaaactacgcttttgtgttgtatatgatttactgttagttgtaggagcagcattgttattaataatggttgtattgctaccgccatctctataaccaccgccgccactattaccactcaacatatgaccaagaagcatacctgtagcaaagtcacctacaccagaagaaccactaccacctccttgcacaacaactgttgaaggttgtgcaggtgctgcttgaacaacttgaggtgcaggttgatttacatattgttcatctaccatctgatttggtgtttgttggtaacgttgattttgtacattttcagaatcatcacaacctaccagcaatgcactacctaatacaactgcaacaataaaagatttaatgtttttcatttgtaaccctctcatttaaagtctcaacacaatttttaaaatccctagagaaacaatacatctgttctccgttcctgttgatagtaattgtatggttatcaatatatgttgtcaagataaaaatcaaacaaaacaaccctaaagcaaaacaaatattttcaaacagaatccaaagaacacgtaaaaccaccatcagatcacctcaacaaagcccccgaaggggcttaatgaattaagcaacagcctggtcttctttttcagggaagattaaacttgcaatgacacccagccccagagtacctaacacaatatacatactgatcgtcggatcaatgtgtgctggcaggaaactcacttttgcgtgcagagtttctgcaaacgggtgatacatcagttttacacccacaaacaccaggactacgataactgctttctccagatgaaccaagtatttcagtgcaacactaaggacaaagaatagagcacgtagacctaaaattgcacacagcattgaagaaaatacaagcagaggttcttgtgtcactgcaattactgctggaacagagtctactgcaaagattacgtcaaccatttccattacaaacacacaaaccagagccggagttgctacacgaacaccatttttgattgtgaagaacttctcaccatccatctgatcagatacagggaacagcttacgaacaatgcgagtagcccagtgtttagagtaatcaacttctgcgtcattatctccagcgaataccattttagctgcacagaaaaggatgaccgcaccgaagaagatattaacataccagcccaaactcaacaagtaagtgcctactgctacaaacacacctcggaagacaatcgcacctgcaataccccaaagtagaatcttgtgttgcaagtgtgtgcttttaataccaaaacttgcgaatactgccacaaatactactaagttatctacagaaagagatttctccaacacatacccactcaagaacaagctcgcaaaatcagcaccgtgttggaagtatacaaaaccatagtaggctaatgataccccaatccagaaaattgaccaaccaactgccgatttaaatgaaatctctttgttttctctgtgtccaaagaaatcaatacaaatcgacaacactaaaatacccactaaaacaaccacatcaataattgggaaacccagttgcattctcttctcctctttaatgcggaggacaatcctccgctctatgtcttatactataaactgtttttaaagaaagtcaactagttcagttctgtaattttaagtttatcttctttgttaatgatagggaaagctacagcatcacctacatcatcaataaagcaaatagcaagaccaccttccactttgctaacctgaccgttaaaggcatgatacggggcaggaacttcatccccatcttcaatgagaatagcctcgtaaaccttgccgatagtacaatcacgggtgtttataaatttttcaagcacttcaacatttactttacgcatataaagatcctctcttatttgttagattgaaagataccacggagtaccgcaagaatgaacgtcacacagactacactccaaaacgttacaggaacatgatgccagtctaagccgataatgtcaatcatataattgtatgctaaaagcagtagccaactagggattaacacaatcaagaacacaacaataaaacaacctaatactgctaaaacacctgccatactttctccttatttcagtttgtaaacaattacatttaaacctttgtttactagagtttcttcgatcataagttttacaatattccaagaacctccagccaaaccacaaccaagcattggtaaacctacaattttaccgcctgaagatacaacatcgtctcccatactatctagcgcattgtagatagcttcataattcaggtcacgcttaccttcctcacgactactataaccatattgtccatataaattataaattgtcaaattgttttctgtatatttggtaaacgtacctaattttttataatcaccacgtttagtggcacaatctgctttaaacgcaccaggccacttgcttttaatttttggtgcaataccactacccatagtgcaaaaacagttacagcagtgtgctatagcgtctatatcgcctctctcggctgctgctaaaagatcaccgtatacctcaacgatacctgctggataacttgttacaatttcatcttcccagtacattttctctacaccaccgatcagtgcaaagttttgtgtaatgcgatcatcaatatagttaagacctgaaacatacacagcgtattcatcctgtgctgtaataccttgcacacgaattcttaagacaccatctttatctgttgctacacgcccaaaatctttttctgtaatattggtgataggatctccgaaagtcattactttattagacataataatcccctttaacattagatttgttgataatgttgctttcaaaaaattgacgtaggaaatcaaagttctctttgtatttttcaacgttattgtaaccttctgcaaggcaaccaaagaacagttgttctacataatacaaaggaagttgtgaaagtgcaattttaaaatcaacttcgctttgactcattagatacttaataggacgaaccaaacatttagcatcagtttcttgcttaatcattttaataaaagctgccagattgttgatatagttgaagttaagtgcagcttcggtattggcttctgtaccttcatactttgcaaagtacaggaaaaacgtatcgttttcaacaccttctttgtctaaaatttcaataagtttttcttcgtgtgttcctgtaatattaacatcatcaatgaaaatcagagttttattaccccagaaatcacgattgatagagaaagtgtcaccatcgatcaaagccttacgatcttctttgctaagaaatccataatcattaatgtagctcactttacgatgaacgatatcccactccactgctttacctcctttgatagagattaggtagttgaggtgatctacaaaatgttcagataacactgtagctgcatttttcacatagttatatggagatggaataacaacaaaactttcatttaccagtcgttcttcatacttagaaaagaaactttcagccagaatgcgccccattctttttgctgcctggttactaccaaactttagcttggaataatctgcaatgttaaattttgcttccttcaggttagtaaaagtattagcaaaatgttgaatttgattacgcattaataagttcctcttttttaagtttagccaacaagtcttctggattaataatatgacagaacttcatccctatgtcaacagcttttccatcatagatcaaactatctccaacgtgtaagatctcctctggtgcgagatcaaacgttaccatttcatcaaaagagagtttaaaaaacctgggatctggtttacacaagcaaaactcatcagaaaaatgcataaagtcaaatggtaattttgtcaagccagaatatacagctaagaaactaccaggtacaaaattggtattgcttttaatactcaaagaataggttgaacttagctcttccaacttcttgcaaagttcagggtttaatattggaggtgtataagagacagttgctaaacagtctctttttaacccatctactttatcaagatcaatgttcaaatgagcagaaagtgtttcccaagcatttctagatgttccacaaatgcctttttctgctcttaaatccaggagagtttttacttctttatatacagttgctgcttctgcctcagaacaagaggcatactcggcaattaccttgttgcgctcttctgcatacaaaggattagcagtaataagagtgttccatacatcaaaagaaatatgcttaacagtcatttttaatcctccgtccaaaagaatatcatctgcttaattttattgatctcttgatgtagtaactttccagcatgtgattgatctttaatattgacagcaagaatttcaagctccgttagtttttcctggatagctttatattcatcatctgtaagcattttcttcccctttagaatggtaatctttgtatatcacttatccccacaccaagaagtctagcaatatccttatctaaaagcaactctttttgttctaaaatgttaatcagatctcctaatacttctttaatgtcacgatcatttttagcaacgtgaccacctgctgtatcaactttatctttaaaaacaaaataatgatccataataccctccatataaataaaggaggctttcgcctccttttatcacttagtaagaacgaccactaaacacatactctgtgtagtttttacgttctttgtttttaataacaacttcaatgttgttacctttatcatcggtgaacataaagtgataaccgtcaccacccattgtacggatgtgtttttcatcatacgttagcaagatacggtctacaccccagtagtagtcaccttcttcatctttatcttctacggtaacgatcccttccatttcaggaagatgctcttcacctagtttatggtctacagctacaacataacgattaccactaaacaaaccttgtgctgtcataccgtcaatatcggtatctgccgaaacatctcctgtacgatctacaccgttaactttcagaagtttaacctcttttgcagcatagcggtgttcagtaatactgatacccattagtgcaagtgcatcagagaatttgtcattagggtaacggttaagttcttctactaatgactgaacaatatcaaagttcaaatccacggagagattataaagcgtttcaaagtctggtaagaaggctttgttctccagatttttagccagataatcatccatagtagctttaggtagtttcttatagctaaaactgtagaaaatacggctaggacgattacgcaaaaattctgatacataaccatcatttttagtcaatacaaacagtttgtcgtagccaccaacaccatccagcagggtaagcaaaccatcttgtgcatctttttcagcatacagtttatcaaattcatcgatcataatcatcacaggttgtgtgattttagacataaaattgataaagccttcaccattaaaagcactaccgatagaaatagtaggaatacccatttcacgaagagcagaagacagcattttagcttgcaaagttttaccgctacctttcgtaccttcaaggagaacacctgtgtttttacctttgcggctaaggaacgttttgataatacgttctgatttatcatcagtatcaccgtatgttactgaagggacttccatatcgtttttaggatacaggaagaactcaccactttgagtaacacctacaccaaaagttcctgctggaatttcttcaatatctgtaccagatttctgacgcagaaagatttgattgccgaatactgtaaacatagttttctcctctctttaatttagtcagattcccaaatgttgtctttcttaacccacattcgttgattatctgaacctctataacgtttcgttgttggttgattcatatcatacttaccatctatcactatgtcaaccagttttttaattttctctggaatttcttcaaaaagatatcctgtatataagacaatatcttttttgtttccaaaacaatcccttaccttctcaagaacatactctacagtgtcaatgttctctttgtcaagaggttcaccacctaaaactgttaatcctttaatgaaaggtcgagataaatcttccaagataagatctaatgtttcagcagtgaactcttgtccgtagctatacgaccaggctttctggttaaagcagccacggcaaccgtggctacaaccgctcacccacaaagagcatcttacaccgtcaccgttgagcatgtcaacaggttcatatccggcgtaattcaaaagtgtttctccctttctagtacctcttgcattttacctttattataagggcgagagttaggagcagaaaggtatcctgacactcttctgatcacagatatggattcttcttcatgatttccacaacttggacactcgaagcctttagctgttgccttaaattcaccatgaaaaccacatttgaaacactgatctacaggttggttcacgccaaaataaggaattttgttgtaggcataatctacaagagtttccagtgcttgcaagttatttttaaggtttggtgtttctacataacctatgttcccaccattactaatttgtgcaaaaccttcctcataatcccatttttggaacggggtagtgtgcatccatacaggttgatggaaagagtttgtcaagtagtcacgatcaatagaaccaggatagcgatcatttaacgctttggcaaatttatagcacaaggattctgctggtgttccatacaaactaaaagctaaaccagaacgttctttaaatgtgcaacagatatccttcatatattgaaggatgtttttacccattgcttttggattggtgttatttgggtataaaatctccatagcttctgctaaacctacataaccgatactaatagaggcataaccaccttcaaataatttaccaatctcttcattagcttctagtcgagctaaagccccttccataaacaatgtagggttttgagatgctttggtatgtctgatacggttaacacgtagcatatgtgccttatacgccatctccatatgttgttccaacagttcagtaaataagatgcccctttcacgggactctgctgcaatgataggtaagtttaaagaaactacgcctaagttgaaacgaccatcatatttttcaccttgctctgttgcataactgtctcttatacacaggcaacccatgcttgtgacgcgaccatctgaagatcctgtaacttctttgtttaaaggtacagagataaaatcaggatagatgcgttcagcacaacactccattgccagttgcttcagatcataatttggatcgccagctttcatgttaacaccatcttccaagaagaagataactttaggaaacacaggagttaccctatcttttcctaacccttgtttgtgcaccattaggtagtttttagtgatcattctaccaaaagcagaggtatccaaacctaaactaattgttataaaaggtgactgaccatttacactcattagggtgttcacctggtagattaaagtttgcattgcatcatagacctgtttatctaccatacgcatagcaatatcataatcgccaacatcggcatatattttattaaaacttgctttaacgtattgactaagcccagtatcaatatgtgcacaagtttgtccaccatattggctagaagctactgcttgaataatttgagttaggacagtagtcgctacaccgatagactttggtttttcaatatgtgcattaccaatacggaaaccgttctcaagcatatcttggtaatttaccaggcaacaattagttagaggtgagagtaaataatctaaatcgtgaatgtgaccatacccacttttatgccattctgccagatcttccggtaaaatatgggtcattgccatgtgcttgcttaggatacctgctagtaagtctcggtgagtattaacaatcattgcaggtttgtttgcattttcacgagtaaattcttcggatgtttgttcgaggaatccgattacatcctcatatagtttttgggtcattaatcctccgtggaaaataaaagccagcattaagctggctttagggtggatctttattttaaatctttttcgtaagattgtccttgatcttagtcaaggtttttggtaatacgtgtgcaaccgtcagaagtcaaaccgtcaacttgagtttcccaagtaccatgaatatttcggaacaatgttgttacaccttttggttcattaataatgattgccataacaagtttaggatcgataacagacataatcttttcctcaataccctctgtaataacattattgcgcacaatattaattgcatcttcttgtacagtaagaacacttacgttcttaagagtatatacctgctgtgtagtgtaaatgatacgaacataacttacagaacgagtaggcacaggtttacgcggtcggcgaaaacgtggttttggtgaagattcagttttactttcatcttttgaataatactcctcaaacagtttagtaaatgtttttacatcaactacaaaccgatctttccgatatggagaattcttatgtgcaccattaataccactgttttcatcgaagaaagtaatgttttcttcagttgaatacattagataatgatctgcattgttccaatgtggttgtggacaacgagaattacaaacggaaagcagataattaatattttctttcgtggcctcagtatccaggaaacacgtattatgcacagtcagttgtactttttcagccatatccttttctttatcctcattggtaagatattcagtacgaagaatttccagaaaattttcaggtgttacttccataaatgtatattcaggatgaagttccatatattcaaatccacaaccatctaattgctgtagaaagttagggtagaagaacaaatcattaacactgtgaatcagatcattgatttctgcttcagttgtgtaaccaaaacttttgtgaattgcctcgttaagaatatgcaggatacccatctcttctgctgcttttttaacttccagtttattagcgtaaaatgcaatcattatgttctccttctaaattagtttaaaatttcttttgcaatggtagaagcaagttttccatcatattgattcggatactctgctttaaggtgtttcatcatatctggcattttcttgcctgtcaaggcaaattcttcggcaatagctcgaagatcatcttcagatagcatttctggtaaatatttctccagagtggtgatatcacgcatagctcgctcacatttgctaagggaagcattaactttcttaagcgagtctagttcctctttagcgtgtgcaataccaatcttaacaatgttaatcataatatcgtcttctgatttgtttagatttgccttttgagtacgagcaaggtcaaactcaccaataatattagttaacaaagcaaaagcacccttatcggttgtacgtgctaagatacgatctgctttcatttgtgtcacaatagacattctattctcctcttatttgctaatgctttgagtcttgtttacaacacggtttattgccagtgaagccctaggctccgcaatacctgttgcatagatataaggatgacctcttggagactccctcataccgaatgaacctaattctaaaccatattcatcctctacgtcaaccccaatattagtgggtactaaatatgttttaactccataataagtagagaagaaacagcgcatagcgttagcatactcttcaattgtagcatcagggtagaactcaatcaactccaatttcaagaaaatattaaaatgggtatcatctaaattttcttctgtacggtaacatggcgttagtgccatatacggattacctgctgcaaattcaaaaccatccttctccatttgcaggaaagattgttctgcactagctacatagtatttaccgttaggatgccctaatgggcgatcctctttattttctggtagtgtgtacgctagtatatcagcatccacgagatatggaacttctaacatttgtgcaaatcgaccatagtaatcaatagcttgagctattactgcaacattcatgatcgacctccattgcggaatgcacgtttagtaatgtttgacatagtgatcaaatcttgaagcgtcatatcaggaaaatgctgttcaagaacaccttcaacagcgcctacaatatctgataactcaataagttgcatcagcttgcagtcttgatcaatagcatcttgaagttcataaagctcttcttgaatcttagcaacagaaccatattcctctttgctaatctccttcaaatgataccctgccactttacccccccttagtttaccagtttatttatgtctggtaaaagatttatttcacctaagaaatcaccttcaccttcctctagccaactctcatatgcttgtgcatgattatagttaccatcaaaagaatctgcaacaaatttttctacagtttttcgagatgtgccagcgccaaatacaccaagtttaataccattgataggtaaagtggtgcttgtgggtactttctctgttgcaacacggttgatatctataatctcctgtacggttgtgttccattgtaagcatttaacacaacgggtgtgcgctacatacagtaggtttcgctctgcctcttctagtcctacccattcaccagtctttttatcataattggaaggaaaatcattagcaacaataacctgatcccactccaaacctttagatttgtgtgctgtagtcaatgtgacttttgctgtaggagaatttctatgcgttctaagtgtatgtgctatagtgtttgccttaccagaaactacaatgtttaacaaacgtttagcatctggatcagcctctgcacactcaacaaattcatcccagtctgcataaggtaatacagtttcatgttttactttctcaatgtctcctctccgaagagcattaacactatctaccatagagataaaatccctggtatctacgttaataataatttcttccccgtctgcaatacgatccattgcctccataagcaaggttaaattcttgcgaaagatgatagtgtaaggctttgtatagtctacaacatctgatttgtagctacctactacagtatcaaagcctttaccaaccaaaggatgacgcaaaggttctttatcacttaaaatcatattcgcaatgtttgccactttggggccaaaacggaagcaagcagttaatggaagttctgccccatatgtagaagtttccttcatcatattttggcttccacggaactggtagatgctctgatattcgtctcccaccactactacttgttttgcagatttagcattccgcagaatagacaagaatgcagggttaacatcctggaattcatccccaaaaataatgtcataaccaagatcagcacctgataattcaaacaattttacataggtgtcatgcgtcatcaaagtatctgtgttaggatcaatgcgctctcgccacaattgttttgcatacttaactacttctgtaattagtttgtgttcgttaataccttttcttttaatatctgcaagatgtacaccaggaaaatgtttacggctgataaaaggatcatccgaaaattcaaacttacctacggtttgcttgatcattaaaccaatcatagcacgagttaaaagtgttttccctcgtttatcaataagattattaatcttaaatttctttgctatctcactacctgtacctgcaacgttaacatactgtccttctggtcgtgacagttttgcacgtaaacgatgatccaggaattgatagcaaatggaatgcaatgtacggcattctacatttggtggcatcttacgccgtgcttcttctgccatgcttttattgaaagctaagtaaagaatgcgatcttctgtactgttagccagcaaataaagtgttgacgttttgcctgatccagatttagcttggatagttaaaaaacgatggtctggaaaagcctccttaatagctgtttgctcttctgttggagtaaaactcaactctttcttagccatttcaacctctcttaatttgtttaacaagcataggaacaaaatctcgttttaaaatttgttcaataatgtgatcaggtagctgttggaaattataattaaaagctactgtttcacctttaggtgtttctacccgcacatataacatgttacgaagtttatccacttgtgctgtatattctaaaccacgtaattgatgcattgcaaacatcaaatcatcagtttcagtttggaatctatcccttgtctgcatcaaggataaggcaaaaggtagattttccctaacagccaccttcttaggcactagtgaagggaaatactccccaataacttcctgtgtaagctgaatacactctttttcaagctggttttgttctttgagttcacaaatacttttttgtaaagtgttaacctctttttgcaaagctgctagttgagcacttaactttcttttttgattacgaccaaaacgtttagacatatttccccctagtaaaaccccttaacaatttgtattaactcggcacaacggttgaccaacttttcatcgtacaatacacgttgtggcatatgttgtataatataccccatttgctcatgccatgtccacttttcttttttgtctgggataacatcactagcacgagaattatcttttaatgtttgtataatccaattacttggaaagtgctctccacctttcttaaatggtttatagtggcctagagtgaattgagaatcccctgttagagcacccaatttatttagatggataatcaaactacgaaacacgtagtattcatagatgttatccaccgtatagcaagcataatatttcaagatgcccttatctcgcggatacttaccaacatccagattgcaccagttgacattttctggatcatagtggtgttccttaagccatatttctctttcatcaaagtctggatatattaccgccctgcttacagagtcaacaagtggagattgagcatcaaaaaacattatattttccttattggtttgttaaacgttttctaaatcttttaaggcattacccaacgttagaacaataacatcgtttgctgcctctttcccattgatattggtgaaatttggtgtgacaaaagtaaccatataaaactcgtccacctggaagatagcaataacaccatccatcttaacatcttgacgaaaggaaaaaccaatcatcttctcttgcaaaggcatatccccttccttcattaccgccagggagttttcaggaatgttatatttatctgctccgatgtagatgtacgtaatgttatctttatcgtgatgatatagggttgctttttccatgtctaaacctgacagatcaaatacgttaatttcttgtgtagtcttcataaatatcctcccaaatccaataatcatctgtgtaagtaggatgccttttatcccactctgttctagcccaagcaaccgctgctaccaacacatcaccatgacaaggttgaggtgagcagaagcaaactaagtctttcccttctaattctaacaaatcctcaagagtgattttaccacaacgaatttgttcccacaaccactctttatatctttgtatagttgatcctcgtggttcatcatcctttaacttgaaaggatttgcaaactttgaggcttttaaccccatatgaggcatagctctgccaatgtacactgcaccttcaggtattactttacctaagtggtaaaaatttaatactttcatattaacccaaacacatctgcgcgatcaagccttgtataaatttattagcttctttactgtcgtagtcagtctcttctggatatccatcttcatcgtacacaactgtaccttcaatataccctgcctcaattaaggcgcggatcatatcaaattgccagcatgagttaccaaatggacgtttaccattaaaacactcttcttctctccataacgtagagagtagttgtcggaaatattcccgtacagtgacagtaccaagatctgaatcctcaaacataacatccagggcatcaggattgcttttctctacataaggaatatatttaacaccattaatagttacatcaagcatttatttctccttatcatcatattctaggaacatatctgcacgatatgctttacgctcttcaaacttagcaggatctacaacaataagcaatacaaggttaacatctaaatactttttaacaaatagaaataaatcttttccacagttaaaacctacaccagtataggcatccccatattgatctactgatttaatcttcttactaaccgtacattctatgctattcttttcttcttggtataaggctttcccaccccaatatgtaaagaatttagtaccgtcagcaccaagtttaaaaccttctgttgcatgtccagcaaatgaaagtaaacataaccaagtaatcatcaggtactttagcattttaaccacccaattgcaaatgtttagaaagaacaatatcccactgatcaccacaaccgttatctatgcggaacataatgtacgtatcatcttcttctacgacatataatacctcataggaattacaacaaccttcccaatttttaacggcttctggtgtatgatgtgtaagaatttcattaccatcatatgaccaaaacaaaggggtgaggttttcgaacgtcagtgaagtagggtttacttcatctttaactgcttcctcatattctttatgtgtttgtactgctttagttagtgtactcatgtctatctccttttctccttcttgactatggaggatagcgaactctctaaactccacctcacgccatgttttcaggtagtgctttataatttgatcaacatttgcctgttcaacgttacttttcaagcaatagtagtcatggtcttcacccattctaccccatatgctatacattgtcatctgattgatccttcacattgttcttggcatacacaggaataacatcatggtgatctttattactttcgtctgttaaagcccaaaacaacttacctgccggatgtttaaagatgtaagcaataggttcctcttcctgtgcttctttgctacggatgccatcccgccaggcaagccaagtgtagatcatcatctcttgacgttcttcttcattaggccacagatggggtagaaagtttttatcaaaccattgcttaaattcttcagtcatagcctactccttagcgtacaaagttaacttctgcttctttcagctttgacacttctacataaccaccatgatcatctttaatccattcttttcctttacggatgataacaggataagtagagtgagtaagtttaggtacagatctttttgttttagtgatagaaatgttttgcatagtaatctccttagtaaactttacatagagtttagattatttagtaggtagagtcaataattaattactgttagatctgtactctgtcttccattcacaatggtaaacttcaacaggttctaacttccagtgttcaggaactagttcaggacaatatctacaaaagagaaatagatagataactaagacaggtattaaatagtaaaatggtatacgatcataaccatacttacgagataacatgtagacatatagatatggtataacaattaaacctataactataagtaagaagagaagtataaaccttagtgtagtaacatccatagtattctcctatacagtaatatactctgttcctgcccctccatgagtgacaggaacaatatctatagagaatactaactcgcttcgctcgtcacctttcaggtttagggtagcatgtttttctgaaaaagtcaatactctccacaaaactttacaaaatgttttttacataggtacaacagagtctgttttgaagtcgtacatatgatttacacctgtgatttttgacatagagattgcacgtttagcacctgcaattacctggtctgtcttcttaatctcttcacggaacttacgcacagttagagagaagaaacgatgatccatccattgacgattcacacgatcacgcttgaagtgacggaaatcttcaatctgtttattgcgcaatcggcgcagtacatgcaataatttatagtaagggtgtttatttttcataatttattctccaaatcgaaaatcgtcaatatcatcaaaccatacacaatggcgagtcctttctttttctgttgcagacattgtttcaacagctttaggactaagcacaacaggaatgtaacgaacaggtcgttcatagtagtagccatacttttctgtattagctgcctcaaagactttacggcgttcttcaagatcttctatggtgaatcctaccatataaccatcatgtttgctaccccatccttcctcactttcaacaatcgggatataaaagccgttacgcgtccctgacgctggtttttcttgagcctgaaggcaagcctcccatcctgctttaaagacgttatagagcgatttacgcacgttatgagtgccgctttcgcttgctggatagagttcattaaatttgtcttgaatttgttgtgtcatactcgccccttagtaattatttgaccagctaaacaaatagcttgtagtacaataaagaagtagcctaattttacactacccaatacccagaatgcaatgtttgcaaacaaacaaaaagcaatattaagtctaaagaataacatttaatccccttcatatttaggtaaaggcatatatgccacaataggagggtaatcaaagtgaaaatgatggttcaccacaataatcttaccagacatacttttatgcacttcacaataccctttttcaccatcttccattaccaccacatactcacctagtgggatatcgtatggatcttctacttttacccattctgtcattttggaaatacctcttgtccatcttcatgcatttgtagtaaagtttcacagatttcatacacatcttggtatgttacaactgagagatcagattcttgatcttcgacaagcatagcacaaagagctttaatgtcaatacctttacaatgttccgtagctacacggtacatttcaccatcctcccaaacaattggttgcgggagcaaaacatctgtaccatcttcacaagttacaatgtagtctgcaatattgtcacgaattttcattgtactacccccttaaatccagatgtactgccagttttaacttttgctttaagatgttccaactctaccataggtgttgctacttgtataggattttcctcaacctcataaatataatattcataataagcatacttaccaatagagtgcagatacttaattgcatgttcaggcgaatctgcttcaacataccctaaatcttttgtggtacgaccttcgcaatcaccttcggtagttacatgataaagtgtcataaaacctcctcatagtaaggtaaagccttgatcagttgttctgaagtgccattttgcacccacgtaacaccattgtcaacagaaacatacccttttttgtcaataaatttacgcagacaaccagtgaacttatttttgtagatcatttcttctttccttttttgattacagcccccgtcacttccttgccaaacttccgctctgaattccatctcaaaccactcaccaccgcaaaaacggctgtgttcaacacgtctatcttccttcattgcttctttagcttcgatagaagttagttcgatgttttgcatttgcttttctcctttcctttggtatgcgctaatcttaacaaaataaaaacgtatgtcaatacttgatttgaaattagtttctggtactctgtgtgtatcgtaacaaaagaggttagatatgaacatcacactagcaactaagaatattacagaaactttcgatggttttggcattattattgctgttcatgggcataacgaaaaatggttagcctcttttgaagaggacaaagaacgcaatgtacgtttgaatgcaccaatcaaagttttacaccaggtaggtgagaataagaaacaatggagatcatacaaagagtggaacattacaaacgaattaatacacaaacttgacaaagtgataaacatgttcgacaatgcaccaagcagtgcaaaacgtgttttactataaaggagagtgatatgaaaattgtacacgatgaaattcaatttgaagagagtgatcttcttgatctggatgtgacactaagtaaactgatctacaacgcactttctgcatatcgtgcaaaagtgatagccacaaacaatgttaaaattcctagtgggttacttcgtcggatgtacccacacgctaaaggtgactatctaccttatatggaagaacgagcagcagaacactggttagaaattcttgaaaaaatggagtcctcttttaaagattcaactccacctgaagaagttaatgaaaaacaacggcaagagcgtttagaaggtcgtattttgtttgctaagtatttccataatttgtggagctaaacatatctggtaaaatcacttatatgttcttagtatacttgtgtaaagaagttatctaacaggtgttgagtggactattaaattaggagggctttaatatgtttagtaaagaaatgagagaagtaattgccactttggtagttgatcatggtgttgaagttgagcgtcacgtttggaacgatgaacctcctttcttcgatttggcatcacgagctaaaagtcatatgcacctgctggaagacggtaatgagtttgttctccgtatgcgttatgatcgagagtttcgaattccgcttgacactgaaccagatggtgtagtaatgtggttggcagaacatttcgcatacgatgcactacatggaagaagttttggtaatgagcgttgggatgccatttgtcgtaagcataatattgaaccagagtacgggagtatgtaatgttaagtatcaaacctaaaatgataacagaagacgaagcagactttattttcaaatgtgggcgtgtatggagagaattcacaaaagggaatgaagtggttgttgttgtcgaacacaagatatctatccaggatctgtttggacaatatgttgatgttattaaattaggtattgacaagggtttagttgaggtgttaacattagatcaagttgaagcagagcacctcgataaagtggtggttgaattttaaaatacagacgggagagaggtatgagtttctttgttacagtatttatggctatctggattgtagtctcactcgttcttttcctggtgggttgtctggaagagattaagaaagcggttatttgcggtttctttggctttattatctctcctgcctggatgtggttcttcattatgattggtttccttaaaaggtaagtgaggaataaagaatgagtaaaacaaacgcaatcgcagataaagcaacggatgtacttctgaacatggttaacgtcactattcaaacaatgagtgatgttgtagagtttggaaaacaacaaattccagaagtaatccatcaattattagtgtggaaagcagtatccgcaggtttatggcaactttttagtatttgctttatgtttattacttttattgctgtgcggaacctcgtaaaagcaattaaagataaagaatgcctgtggtcacgagatcgctatggtgaagtatctgctttacctattgttggtcttgttgtctgtgctttctttttctttttaggatttgttattttcttttcgaattttgattggctaaaaatcattattgcaccaaaagtgtatctgattgaatttgctgctgatttaattcgttcatctcaacaaaaataaaaggggttaaaatgaaatacacgatttatggtgatattgtaagtgtaaataaagatatgggtgtggaatctaattatcttccacctggattctatactgttagtcgtgatccccttggcaattattttttaagccgtggtaatctaacaggtgtaccggatgttctgtatggtgaaacagaaaaacgagcaaatcacgttatccgtacattccatcgccggagtgcacaaggtaaaaatacaggtttgcttctgacaggaactaagggcagtggtaaaactatgttagccaagctcattagtcgtgaccttgtagaagaaggtattccaactattattgttactcaagcctacagtgctgctaatttcattcctcttattagcaagatcaccgacaaagcagtgattatttttgacgaatttgataaagtatatgagaagaaacaagatcaagaagcacttctcactttgttagatggtactggcagtggtaataaactgtttattctgactaaaaacagtggctttatctctgaattctttctaaatcgtcctagtcgtgtgttttataattttaattatgataaaatctcactagaaactatgattgactatttagataaaaacctggataacaaagcacactttgataatttccaaagactttgggatgtaagtttagagttgtcctttgatgtgatccaaggtatagtagaagaacttaatttctaccctgatttatcctttaaagaatgcatctctatgatgggagtttctttgggtggtggtaataaatgggatatcagcagcgttgttattaatggaaaacttcagaaagttagctgggtatctagttggcataacttcacacctgcaatctttttaggtggttcgtgcacactagacgtgtacttgtcatctccaagtgatgcagactctaaagaagcccttgctaatagctcttacgtggtttttgatgatgaaggcgatgctcgaattccattgaatgcgacaaaaatgaaagcagatcttattacaggcggtaaaatcgttgtgtttagtgatgatccagaagattctttccgtattgttctggaaccaactatcaccaatggtgcaacttaggcaagcgtgttttaagtaagccagcaaataaaaacccgcttcggcgggttttcttgcattgatccaggatttataagaagggtaaatggtgaaagccacaaaaacatggggaaaaaaaaaaggagaaattaaaaccctttctaaaaaacgcaattttccaatccttgggttagttgggtaaatgaaagggaaaaagaataaacttaaagtatttttccccaaacatggagaatggaacaacaagaaaaataattaatttaaaaagggaagttgttgtcctaaccgttctggttaagagcccttaaaaagggaaacagaaatgccggtcttggaaggggtaacaaaggagaggggggatcaagtgttaaggttcgtgggggaattgaaagggaaaaaaaaaaaaattgatttgttgtgttaatgtgggttttaattggattataacaagattaaaaagtttaaaagttgtagcgggttgccaaaatggaagagggaaataccgtagaagatattttatcaactttgtaaaaaacacgtataattcattaatgccagatttaataagaggagtagtagatggcagcaccaaaatcatgggaacaatataaagaagagtgtataccaatagcagagagtaagcaaatccaaatcttaggatgaaggggaaatggaaagggggccacacaaaacttgatttgttgtgccattgtgggtaagatgggaaaatacaaaaaattttaaaatttaaatcgggcgagggtttccccagtgtgggggggggaaaggagggcagggccccagtaaaaaacccgagcaaaactttcacgagtgtagagagatcaaaacccaagaaaatttggctatcaaagggatacatggggactgggaaaggcataaaaaaaaaatttactgcacttttgatctacatgggggatgggacagcacaaaaatttaaaaattttaaacggggaaggggtttccccaaagtgcaaaagtgaaaaaaaacgaaaaaatgaaaaaacccgacgatgaaaagatttccccttttccttctaaaagtgaaaatcccaaaaggactatcttttaaagttttgatcgggttaataaacgagggtttcccgagtatttggttttgtatttccccatctgtgcacagggtgaaaaagctcaaactgggctatgtagtgggtgggtttagagttttgcgagtagctttcaaaaaagggggtttgctttcccttttagtgggaaaccccgggatacagacgatcagaaaacatttcctgcaaagaaactgtgtgagggtaaagggtatcagtttttttggttgggttataaaggggggaaacagtataaattttaaaatctgtgccccgaaaacgggggacaaaatttaaagttttggaaaatgttttctcatgggccggggtgccccggaagtgctgggcatagtcaaaagcaaatttatatttaaatcgtttaaaataaagatattttagtttctctttaattttggatagctaaaaaaagtgatacacgatttaaatatcaaaaactccctaaaatgttttttttggggcgtatttttttttatgatttttgcacagtgaaacagtgtaaaggtgctgaaaaagctataaaaaaaaaaattaaaaatgggatctttaaagcaaaagagtttaaaaatgggtttacagaaaaagtaaatgtttttgattttggaaaactttaaaaaaatttttcacaaaatggggggg

What is claimed is:

1. A method of treating or preventing a bacterial infection in an individual in need thereof, comprising administering to the individual an effective amount of a composition comprising: (a) at least two bacteriophage that target a Gram-negative bacteria selected from the group consisting of: (i) a bacteriophage having a genome sequence having at least about 95% sequence identity to SEQ ID NO: 2; (ii) a bacteriophage having a genome sequence having at least about 95% sequence identity to SEQ ID NO: 3; (iii) a bacteriophage having a genome sequence having at least about 95% sequence identity to SEQ ID NO: 4; (iv) a bacteriophage having a genome sequence having at least about 95% sequence identity to SEQ ID NO: 5; and (v) a bacteriophage having a genome sequence having at least about 95% sequence identity to SEQ ID NO: 1; and (b) a buffering agent.

2. A method of inhibiting bacteria adhesion, invasion, and/or colonization of epithelial cells of an individual in need thereof, comprising administering to the individual an effective amount of a composition comprising: (a) at least two bacteriophage that target a Gram-negative bacteria selected from the group consisting of: (i) a bacteriophage having a genome sequence having at least about 95% sequence identity to SEQ ID NO: 2; (ii) a bacteriophage having a genome sequence having at least about 95% sequence identity to SEQ ID NO: 3; (iii) a bacteriophage having a genome sequence having at least about 95% sequence identity to SEQ ID NO: 4; (iv) a bacteriophage having a genome sequence having at least about 95% sequence identity to SEQ ID NO: 5; and (v) a bacteriophage having a genome sequence having at least about 95% sequence identity to SEQ ID NO: 1; and (b) a buffering agent.

3. A method of inhibiting bacteria growth in a target composition, comprising contacting the target composition with an effective amount of a composition comprising: (a) at least two bacteriophage that target a Gram-negative bacteria selected from the group consisting of: (i) a bacteriophage having a genome sequence having at least about 95% sequence identity to SEQ ID NO: 2; (ii) a bacteriophage having a genome sequence having at least about 95% sequence identity to SEQ ID NO: 3; (iii) a bacteriophage having a genome sequence having at least about 95% sequence identity to SEQ ID NO: 4; (iv) a bacteriophage having a genome sequence having at least about 95% sequence identity to SEQ ID NO: 5; and (v) a bacteriophage having a genome sequence having at least about 95% sequence identity to SEQ ID NO: 1; and (b) a buffering agent.

4. A composition comprising (a) at least four bacteriophage that target a Gram-negative bacteria selected from the group consisting of: (i) a bacteriophage having a genome sequence having at least about 95% sequence identity to SEQ ID NO: 2; (ii) a bacteriophage having a genome sequence having at least about 95% sequence identity to SEQ ID NO: 3; (iii) a bacteriophage having a genome sequence having at least about 95% sequence identity to SEQ ID NO: 4; (iv) a bacteriophage having a genome sequence having at least about 95% sequence identity to SEQ ID NO: 5; and (v) a bacteriophage having a genome sequence having at least about 95% sequence identity to SEQ ID NO: 1; and (b) a buffering agent.

5. A composition comprising at least four bacteriophage that target a Gram-negative bacteria, the composition comprising p0031, p0032, p0033, and p0034, and a buffering agent.

6. The method of claim 1, where the bacterial infection is an *E. coli* infection.

7. The method of claim 2, where the bacteria is *E. coli*.

8. The method of claim 3, where the bacteria is *E. coli*.

9. The method of claim 1, wherein the composition comprises at least two bacteriophage that target a Gram-negative bacteria selected from the group consisting of: p0031, p0032, p0033, and p0034.

10. The method of claim 1, wherein the composition comprises a bacteriophage comprising a genome sequence having at least about 95% sequence identity to a genome sequence of p0031.

11. The method of claim 1, wherein the composition comprises at least three bacteriophage that target a Gram-negative bacteria selected from the group consisting of: (i) the bacteriophage having a genome sequence having at least about 95% sequence identity to SEQ ID NO: 2; (ii) the bacteriophage having a genome sequence having at least about 95% sequence identity to SEQ ID NO: 3 (iii) the bacteriophage having a genome sequence having at least about 95% sequence identity to SEQ ID NO: 4; (iv) the bacteriophage having a genome sequence having at least about 95% sequence identity to SEQ ID NO: 5; and (v) the bacteriophage having a genome sequence having at least about 95% sequence identity to SEQ ID NO: 1.

12. The method of claim 2, wherein the composition comprises at least two bacteriophage that target a Gram-negative bacteria selected from the group consisting of: p0031, p0032, p0033, and p0034.

13. The method of claim 2, wherein the composition comprises a bacteriophage comprising a genome sequence having at least about 95% sequence identity to a genome sequence of p0031.

14. The method of claim 2, wherein the composition comprises at least three bacteriophage that target a Gram-negative bacteria selected from the group consisting of: (i) the bacteriophage having a genome sequence having at least about 95% sequence identity to SEQ ID NO: 2; (ii) the bacteriophage having a genome sequence having at least about 95% sequence identity to SEQ ID NO: 3 (iii) the bacteriophage having a genome sequence having at least about 95% sequence identity to SEQ ID NO: 4; (iv) the bacteriophage having a genome sequence having at least about 95% sequence identity to SEQ ID NO: 5; and (v) the bacteriophage having a genome sequence having at least about 95% sequence identity to SEQ ID NO: 1.

15. The method of claim 3, wherein the composition comprises at least two bacteriophage that target a Gram-negative bacteria selected from the group consisting of: p0031, p0032, p0033, and p0034.

16. The method of claim 3, wherein the composition comprises a bacteriophage comprising a genome sequence having at least about 95% sequence identity to a genome sequence of p0031.

17. The method of claim 3, wherein the composition comprises at least three bacteriophage that target a Gram-negative bacteria selected from the group consisting of: (i) the bacteriophage having a genome sequence having at least about 95% sequence identity to SEQ ID NO: 2; (ii) the bacteriophage having a genome sequence having at least about 95% sequence identity to SEQ ID NO: 3 (iii) the bacteriophage having a genome sequence having at least about 95% sequence identity to SEQ ID NO: 4; (iv) the bacteriophage having a genome sequence having at least about 95% sequence identity to SEQ ID NO: 5; and (v) the bacteriophage having a genome sequence having at least about 95% sequence identity to SEQ ID NO: 1.

* * * * *